US007358351B2

(12) United States Patent
St. Croix et al.

(10) Patent No.: US 7,358,351 B2
(45) Date of Patent: Apr. 15, 2008

(54) ENDOTHELIAL CELL EXPRESSION PATTERNS

(75) Inventors: Brad St. Croix, Frederick, MD (US); Bert Vogelstein, Baltimore, MD (US); Kenneth W. Kinzler, Bel Air, MD (US)

(73) Assignee: The Johns Hopkins University, Baltimore, MD (US)

( * ) Notice: Subject to any disclaimer, the term of this patent is extended or adjusted under 35 U.S.C. 154(b) by 133 days.

(21) Appl. No.: 10/979,159

(22) Filed: Nov. 3, 2004

(65) Prior Publication Data

US 2005/0142138 A1 Jun. 30, 2005

Related U.S. Application Data

(63) Continuation of application No. 09/918,715, filed on Aug. 1, 2001.

(60) Provisional application No. 60/222,599, filed on Aug. 2, 2000, provisional application No. 60/224,360, filed on Aug. 11, 2000, provisional application No. 60/282,850, filed on Apr. 11, 2001.

(51) Int. Cl.
*C07H 21/04* (2006.01)
*C12P 19/34* (2006.01)
(52) U.S. Cl. .................................. 536/23.1; 435/91.1
(58) Field of Classification Search ..................... None
See application file for complete search history.

(56) References Cited

U.S. PATENT DOCUMENTS

| 5,342,757 | A | 8/1994 | Garin-Chesa et al. |
| 5,437,865 | A | 8/1995 | Garin-Chesa et al. |
| 5,811,522 | A | 9/1998 | Wallace et al. |
| 6,090,930 | A | 7/2000 | Wallace et al. |
| 6,217,868 | B1 | 4/2001 | Wallace et al. |
| 6,380,362 | B1 * | 4/2002 | Watson et al. ............. 530/350 |
| 6,391,302 | B1 | 5/2002 | Wallace et al. |

FOREIGN PATENT DOCUMENTS

| DE | 19820190 | 11/1999 |
| EP | 1074617 | 2/2001 |
| WO | WO 93/25669 | 12/1993 |
| WO | WO 98/37094 | 8/1998 |
| WO | WO 98/45435 | 10/1998 |
| WO | WO 99/54443 | 10/1999 |
| WO | WO 99/55858 | 11/1999 |
| WO | WO 00/69884 | 11/2000 |
| WO | WO 01/09317 | 2/2001 |
| WO | WO 01/48192 | 7/2001 |
| WO | WO 01/53455 | 7/2001 |
| WO | WO 01/54474 | 8/2001 |
| WO | WO 01/55201 | 8/2001 |
| WO | WO 01/55317 | 8/2001 |
| WO | WO 01/55320 | 8/2001 |
| WO | WO 01/55441 | 8/2001 |
| WO | WO 01/57182 | 8/2001 |
| WO | WO 01/57190 | 8/2001 |
| WO | WO 01/75067 | 10/2001 |
| WO | WO 01/90304 | 11/2001 |
| WO | WO 01/90357 | 11/2001 |
| WO | WO 01/94629 | 12/2001 |
| WO | WO 02/02055 | 1/2002 |
| WO | WO 02/10217 | 2/2002 |
| WO | WO 02/10449 | 2/2002 |
| WO | WO 02/24956 | 3/2002 |

OTHER PUBLICATIONS

Overbeek (1994, "Factors affectig transgenic animal production," Transgenic animal technology, pp. 96-98).*
Wall, 1996 Theriogenology, vol. 45, pp. 57-68.*
Houdebine, 1994, J. Biotech. vol. 34, pp. 269-287.*
Kappell, 1992, Current Opinions in Biotechnology, vol. 3, pp. 548-553.*
Cameron, 1997, Molec. Biol. 7, pp. 253-265.*
Niemann, 1997, Transg. Res. 7, pp. 73-75.*
Mullins (1993, Hypertension, vol. 22, pp. 630-633).*
Mullins (1990, Nature, vol. 344, 541-544.*
Hammer (1990, Cell, vol. 63, 1099-1112.*
Mullins, 1989, EMBO J., vol. 8, pp. 4065-4072.*
Taurog, 1988, Jour. Immunol., vol. 141, pp. 4020-4023.*
Mullins (1996, J. Clin. Invest. vol. 98, pp. S37-S40).*
Rettig et al (PNAS USA Nov. 1992; 89:10832-10836).*
Jansen, M et al, 1995, Pediatric Res, 37 (6): 681-686).*
Alberts et al. (Molecular Biology of the Cell, 3rd edition, 1994, p. 465).*
Shantz and Pegg (Int J of Biochem and Cell Biol., 1999, vol. 31, pp. 107-122).*
McClean and Hill (Eur J of Cancer, 1993, vol. 29A, pp. 2243-2248).*

(Continued)

*Primary Examiner*—Christopher Yaen
(74) *Attorney, Agent, or Firm*—Banner & Witcoff, Ltd.

(57) ABSTRACT

To gain a better understanding of tumor angiogenesis, new techniques for isolating endothelial cells (ECs) and evaluating gene expression patterns were developed. When transcripts from ECs derived from normal and malignant colorectal tissues were compared with transcripts from non-endothelial cells, over 170 genes predominantly expressed in the endothelium were identified. Comparison between normal- and tumor-derived endothelium revealed 79 differentially expressed genes, including 46 that were specifically elevated in tumor-associated endothelium. Experiments with representative genes from this group demonstrated that most were similarly expressed in the endothelium of primary lung, breast, brain, and pancreatic cancers as well as in metastatic lesions of the liver. These results demonstrate that neoplastic and normal endothelium in humans are distinct at the molecular level, and have significant implications for the development of anti-angiogenic therapies in the future.

20 Claims, 4 Drawing Sheets

OTHER PUBLICATIONS

Fu et al (EMBO Journal, 1996, vol. 15, pp. 4392-4401).*
Yokota, J et al (Oncogene, 1988,vol. 3, pp. 471-475).*
Burgess et al., J of Cell Bio. 111:2129-2138, 1990.*
Lazar et al. Molecular and Cellular Biology 8:1247-1252, 1988.*
Bowie et al. Science, 247:1306-1310, 1990.*
Reiger et al (Glossary of Genetics and Cytogenetics, Classical and Molecular, 4th Ed., Springer-Verlay, Berlin, 1976).*

Christian, S. et al., "Molecular Cloning and Characterization of Endosialin, a C-type Lectin-like Cell Surface Receptor of Tumor Endothelium," *J. Bio. Chem.*, (Mar. 9, 2001), vol. 276, No. 10, pp. 7408-7414.
Rettig, W. et al., "Identification of endosialin, a cell surface glycoprotein of vascular endothelial cells in human cancer," *Proc. Natl. Acad. Sci.* USA, (Nov. 1992), vol. 89, pp. 10832-10836.

\* cited by examiner

ENDOTHELIAL CELL EXPRESSION PATTERNS

This application is a continuation of U.S. Ser. No. 09/918,715, filed Aug. 1, 2001. This application claims the benefit of provisional applications Ser. Nos. 60/222,599 filed Aug. 2, 2000, 60/224,360 filed Aug. 11, 2000, and 60/282,850 filed Apr. 11, 2001, the disclosures of which are expressly incorporated herein.

The U.S. government retains certain rights in the invention by virtue of the provisions of National Institutes of Heath grants CA57345 and CA43460, which supported this work.

TECHNICAL FIELD OF THE INVENTION

This invention is related to the area of angiogenesis and anti-angiogenesis. In particular, it relates to genes which are characteristically expressed in tumor endothelial and normal endothelial cells.

BACKGROUND OF THE INVENTION

It is now widely recognized that tumors require a blood supply for expansive growth. This recognition has stimulated a profusion of research on tumor angiogenesis, based on the idea that the vasculature in tumors represents a potential therapeutic target. However, several basic questions about tumor endothelium remain unanswered. For example, are vessels of tumors qualitatively different from normal vessels of the same tissue? What is the relationship of tumor endothelium to endothelium of healing wounds or other physiological or pathological forms of angiogenesis? The answers to these questions critically impact on the potential for new therapeutic approaches to inhibit angiogenesis in a specific manner.

There is a continuing need in the art to characterize the vasculature of tumors relative to normal vasculature so that any differences can be exploited for therapeutic and diagnostic benefits.

One technique which can be used to characterize gene expression, or more precisely gene transcription, is termed serial analysis of gene expression (SAGE). Briefly, the SAGE approach is a method for the rapid quantitative and qualitative analysis of mRNA transcripts based upon the isolation and analysis of short defined sequence tags (SAGE Tags) corresponding to expressed genes. Each Tag is a short nucleotide sequences (9-17 base pairs in length) from a defined position in the transcript. In the SAGE method, the Tags are dimerized to reduce bias inherent in cloning or amplification reactions. (See, U.S. Pat. No. 5,695,937) SAGE is particularly suited to the characterization of genes associated with vasculature stimulation or inhibition because it is capable of detecting rare sequences, evaluating large numbers of sequences at one time, and to provide a basis for the identification of previously unknown genes.

SUMMARY OF THE INVENTION

One embodiment of the invention provides an isolated molecule comprising an antibody variable region which specifically binds to an extracellular domain of a TEM protein selected from the group consisting of: 1, 3, 9, 17, 19, and 44, as shown in SEQ ID NO: 196, 200, 212, 230, 232, and 271, respectively. The molecule can be, for example, an in tact antibody molecule, a single chain variable region (ScFv), a monoclonal antibody, a humanized antibody, or a human antibody. The molecule can optionally be bound to a cytotoxic moiety, bound to a therapeutic moiety, bound to a detectable moiety, or bound to an anti-tumor agent.

According to another embodiment of the invention a method of inhibiting neoangiogenesis is provided. An effective amount of an isolated molecule comprising an antibody variable region which specifically binds to an extracellular domain of a TEM protein selected from the group consisting of: 1, 3, 9, 17, 19, 22, and 44, as shown in SEQ ID NO: 196, 200, 212, 230, 232, 238, and 271, respectively, is administered to a subject in need thereof. Neoangiogenesis is consequently inhibited. The subject may bear a vascularized tumor, may have polycystic kidney disease, may have diabetic retinopathy, may have rheumatoid arthritis, may have psoriasis, for example.

Another aspect of the invention is a method of inhibiting tumor growth. An effective amount of an isolated molecule comprising an antibody variable region which specifically binds to an extracellular domain of a TEM protein selected from the group consisting of: 1, 3, 9, 17, 19, 22, and 44, as shown in SEQ ID NO: 196, 200, 212, 230, 232, 238, and 271, respectively, is administered to a human subject bearing a tumor. The growth of the tumor is consequently inhibited.

Still another aspect of the invention provides an isolated molecule comprising an antibody variable region which specifically binds to a TEM protein selected from the group consisting of: 3, 9, 17, 19, and 44, as shown in SEQ ID NO: 200, 212, 230, 232, and 271, respectively. The molecule can be, for example, an in tact antibody molecule, a single chain variable region (ScFv), a monoclonal antibody, a humanized antibody, or a human antibody. The molecule can optionally be bound to a cytotoxic moiety, bound to a therapeutic moiety, bound to a detectable moiety, or bound to an anti-tumor agent.

According to still another aspect of the invention an isolated and purified human transmembrane protein is provided. The protein is selected from the group consisting of: TEM 3, 9, 17, and 19 as shown in SEQ ID NO: 200, 212, 230, and 232, respectively.

Yet another aspect of the invention is an isolated and purified nucleic acid molecule comprising a coding sequence for a transmembrane TEM selected from the group consisting of: TEM 3, 9, 17, and 19 as shown in SEQ ID NO: 200, 212, 230, and 232, respectively. The isolated and purified nucleic acid molecule may optionally comprise a coding sequence selected from those shown in SEQ ID NO: 199, 211, 229, and 231.

Still another aspect of the invention is a recombinant host cell which comprises a nucleic acid molecule. The nucleic acid molecule comprises a coding sequence for a transmembrane TEM selected from the group consisting of: TEM 3, 9, 17, and 19 as shown in SEQ ID NO: 200, 212, 230, and 232, respectively. The recombinant host cell optionally comprises a coding sequence selected from those shown in SEQ ID NO: 199, 211, 229, and 231.

According to one embodiment of the invention a method is provided for inducing an immune response in a mammal. A nucleic acid molecule comprising a coding sequence for a human transmembrane protein selected from the group consisting of: TEM 1, 3, 9, 13, 17, 19, 22, 30, and 44 as shown in SEQ ID NO: 196, 200. 212, 220, 230, 232, 238, 250, and 271, respectively, is administered to the mammal. An immune response to the human transmembrane protein is thereby induced in the mammal. Optionally the coding sequence is shown in SEQ ID NO: 196, 200, 212, 220, 230, 232, 238, 250 and 271.

According to yet another embodiment of the invention a method of inducing an immune response in a mammal is provided. A purified human transmembrane protein selected from the group consisting of: TEM 1, 3, 9, 13, 17, 19, 22, 30, and 44 as shown in SEQ ID NO: 196, 200, 212, 220, 230, 232, 238, 250 and 271, respectively, is administered to the mammal. An immune response to the human transmembrane protein is thereby induced in the mammal.

Another aspect of the invention is a method for identification of a ligand involved in endothelial cell regulation. A test compound is contacted with an isolated and purified human trasmembrane protein selected from the group consisting of 1, 3, 9, 13, 17, 30, 19, and 44 as shown in SEQ ID NO: 196, 200, 212, 220, 230, 232, 250, and 271. The isolated and purified human trasmembrane protein is also contacted with a molecule comprising an antibody variable region which specifically binds to an extracellular domain of a TEM protein selected from the group consisting of: 1, 3, 9, 13, 17, 30, 19, and 44 as shown in SEQ ID NO: 196, 200, 212, 220, 230, 232, 250, and 271 respectively. Binding of the molecule comprising an antibody variable region to the human transmembrane protein is determined. A test compound which diminishes the binding of the molecule comprising an antibody variable region to the human transmembrane protein is identified as a ligand involved in endothelial cell regulation.

Yet another aspect of the invention is a method for identification of a ligand involved in endothelial cell regulation. A test compound is contacted with a cell comprising a human transmembrane protein selected from the group consisting of 1, 3, 9, 17, and 19 as shown in SEQ ID NO: 196, 200, 212, 230, and 232. The cell is also contacted with a molecule comprising an antibody variable region which specifically binds to an extracellular domain of a TEM protein selected from the group consisting of: 1, 3, 9, 17, and 19 as shown in SEQ ID NO: 196, 200, 212, 230, and 232, respectively. Binding of the molecule comprising an antibody variable region to the cell is determined. A test compound which diminishes the binding of the molecule comprising an antibody variable region to the cell is identified as a ligand involved in endothelial cell regulation.

Yet another aspect of the invention is a method for identification of a ligand involved in endothelial cell regulation. A test compound is contacted with a human transmembrane protein selected from the group consisting of 1, 2, 3, 4, 5, 6, 7, 8, 9, 10, 11, 12, 14, 15, 16, 17, 19, 20, 21, 22, 24, 25, 27, 28, 29, 40, 31, 33, 35, 36, 37, 38, 39, 41, 42, 44, 45, and 46 as shown in SEQ ID NO: 196, 198, 200, 202, 204, 206, 208, 210, 212, 214, 216, 218, 223 & 224, 226, 228, 230, 232, 234, 236, 238, 240, 242, 244, 246, 248, 250, 252, 254, 358, 257, 259, 261, 263, 267, 269, 271, 273, and 275. Binding of a test compound to the human transmembrane protein is determined. A test compound which binds to the protein is identified as a ligand involved in endothelial cell regulation.

Another embodiment of the present invention is a soluble form of a human transmembrane protein selected from the group consisting of: TEM 1, 3, 9, 17, 19, 22, 30, and 44 as shown in SEQ ID NO: 196, 200, 212, 230, 232, 238, 250, and 271 respectively. The soluble forms lack transmembrane domains. The soluble form may consist of an extracellular domain of the human transmembrane protein.

Also provided by the present invention is a method of inhibiting neoangiogenesis in a patient. A soluble form of a human transmembrane protein is adminstered to the patient. Neoangiogenesis in the patient is consequently inhibited. The patient may bear a vascularized tumor, may have polycystic kidney disease, may have diabetic retinopathy, may have rheumatoid arthritis, or may have psoriasis, for example.

Another embodiment of the invention provides a method of inhibiting neoangiogenesis in a patient. A soluble form of a human transmembrane protein is administered to the patient. Neoangiogenesis in the patient is consequently inhibited. The patient may bear a vascularized tumor, may have polycystic kidney disease, may have diabetic retinopathy, may have rheumatoid arthritis, or may have psoriasis, for example.

According to still another aspect of the invention a method of identifying regions of neoangiogenesis in a patient is provided. A molecule comprising an antibody variable region which specifically binds to an extracellular domain of a TEM protein selected from the group consisting of: 1, 3, 9, 13, 17, 19, 22, 30, and 44, as shown in SEQ ID NO: 196, 200, 212, 220, 230, 232, 238, 250, and 271, respectively, is administered to a patient. The molecule is bound to a detectable moiety. The detectable moiety is detected in the patient, thereby identifying neoangiogenesis.

According to another aspect of the invention a method is provided for inducing an immune response to tumor endothelial cells in a patient. A mouse TEM protein selected from the group consisting of: 1, 2, 3, 9, 13, 17, 19, 22, and 30 as shown in SEQ ID NO: 291, 293, 299, 295, 303, 297, 301, 305, and 307, is administered to a patient in need thereof. An immune response to a human TEM protein is consequently induced.

Still another embodiment of the invention is a method of screening for neoangiogenesis in a patient. A body fluid collected from the patient is contacted with a molecule comprising an antibody variable region which specifically binds to an extracellular domain of a TEM protein selected from the group consisting of: 1, 3, 9, 17, 19, and 44, as shown in SEQ ID NO: 196, 200, 212, 230, 232, and 271, respectively. Detection of cross-reactive material in the body fluid with the molecule indicates neo-angiogenesis in the patient.

Still another embodiment of the invention provides a method of inhibiting neoangiogenesis in a patient. A molecule comprising an antibody variable region which specifically binds to a TEM protein selected from the group consisting of: 4, 6, 7, 10, 12, 14, 20, 25, 27, 31, 36, 37, 38, 39, and 40 as shown in SEQ ID NO: 202, 206, 208, 214, 218, 223 and 224, 234, 242, 244, 252, 257, 259, 261, 263, and 265, is administered to the patient. Neoangiogenesis in the patient consequently inhibited.

Yet another aspect of the invention is a method of screening for neoangiogenesis in a patient. A body fluid collected from the patient is contacted with a molecule comprising an antibody variable region which specifically binds to a TEM protein selected from the group consisting of: 4, 6, 7, 10, 12, 14, 20, 25, 27, 31, 36, 37, 38, 39, and 40, as shown in SEQ ID NO: 202, 206, 208, 214, 218, 223 & 224, 234, 242, 244, 252, 257, 259, 261, 263, and 265, respectively. Detection of cross-reactive material in the body fluid with the molecule indicates neoangiogenesis in the patient.

Also provided by the present invention is a method of promoting neoangiogenesis in a patient. A TEM protein selected from the group consisting of: 4, 6, 7, 10, 12, 14, 20, 25, 27, 31, 36, 37, 38, 39, and 40, as shown in SEQ ID NO: 202, 206, 208, 214, 218, 223 & 224, 234, 242, 244, 252, 257, 259, 261, 263, and 265, is administered to a patient in need of neoangiogenesis. Neoangiogenesis in the patient is consequently stimulated.

One embodiment of the invention provides a method of promoting neoangiogenesis in a patient. A nucleic acid molecule encoding a TEM protein selected from the group consisting of: 4, 6, 7, 10, 12, 14, 20, 25, 27, 31, 36, 37, 38, 39, and 40, as shown in SEQ ID NO: 201, 205, 207, 213, 217, 221 & 222, 233, 241, 243, 251, 256, 258, 260, 262, and 264, is administered to a patient in need of neoangiogenesis. The TEM protein is consequently expressed and neoangiogenesis in the patient is stimulated.

Another embodiment of the invention provides a method of screening for neoangiogenesis in a patient. A TEM protein selected from the group consisting of: 4, 6, 7, 10, 12, 14, 20, 25, 27, 31, 36, 37, 38, 39, and 40, as shown in SEQ ID NO: 202, 206, 208, 214, 218, 223 & 224, 234, 242, 244, 252, 257, 259, 261, 263, and 265, respectively, is detected in a body fluid collected from the patient. Detection of the TEM protein indicates neoangiogenesis in the patient.

Another aspect of the invention is a method of screening for neoangiogenesis in a patient. A nucleic acid encoding a TEM protein selected from the group consisting of: 4, 6, 7, 10; 12, 14, 20, 25, 27, 31, 36, 37, 38, 39, and 40 is detected in a body fluid collected from the patient. The nucleic acid is selected from the group consisting of those shown in SEQ ID NO: 201, 205, 207, 213, 217, 221 & 222, 233, 241, 243, 251, 256, 258, 260, 262, and 264. Detection of the TEM protein indicates neoangiogenesis in the patient.

Yet another embodiment of the invention is an isolated and purified nucleic acid molecule which encodes a NEM protein selected from the group consisting of: 14, 22, 23, and 33 as shown in SEQ ID NO: 279, 283, 285, 286, 287, and 289. The nucleic acid molecule optionally comprises a coding sequence as shown in SEQ ID NO: 278, 282, 284, and 288. The nucleic acid may be maintained in a recombinant host cell.

The present invention also provides an isolated and purified NEM protein selected from the group consisting of: 14, 22, 23, and 33 as shown in SEQ ID NO: 279, 283, 285, 286, 287, and 289.

The present invention further provides an isolated molecule comprising an antibody variable region which specifically binds to a NEM protein selected from the group consisting of: 14, 22, 23, and 33, as shown in SEQ ID NO: 279, 283, 285, 286, 287, and 289.

An additional embodiment of the present invention is a method of inhibiting neoangiogenesis. An effective amount of a NEM protein selected from the group consisting of: 14, 22, 23, and 33 as shown in SEQ ID NO: 279, 283, 285, 286, 287, and 289 is administered to a subject in need thereof Neoangiogenesis is thereby inhibited.

A still further embodiment of the invention is a method to identify candidate drugs for treating tumors. Cells which express one or more TEM genes selected from the group consisting of: 1, 2, 3, 4, 5, 6, 7, 8, 9, 10, 11, 12, 14, 15, 16, 17, 19, 20, 21, 22, 24, 25, 27, 28, 29, 40, 31, 33, 35, 36, 37, 38, 39, 41, 42, 44, 45, and 46 as shown in SEQ ID NO: 195, 197, 199, 201, 203, 205, 207, 209, 211, 213, 215, 217, 221 & 222, 225, 227, 229, 231, 233, 235, 237, 239, 241, 243, 245, 247, 249, 251, 253, 255, 256, 258, 260, 262, 266, 268, 270, 272, and 274, respectively, are contacted with a test compound. Expression of said one or more TEM genes is determined by hybridization of mRNA of said cells to a nucleic acid probe which is complementary to said mRNA. A test compound is identified as a candidate drug for treating tumors if it decreases expression of said one or more TEM genes. Optionally the cells are endothelial cells. Alternatively or additionally, the cells are recombinant host cells which are transfected with an expression construct which encodes said one or more TEMs. Test compounds which increase expression can be identified as candidates for promoting wound healing.

Yet another embodiment of the invention is a method to identify candidate drugs for treating tumors. Cells which express one or more TEM proteins selected from the group consisting of: 1, 2, 3, 4, 5, 6, 7, 8, 9, 10, 11, 12, 14, 15, 16, 17, 19, 20, 21, 22, 24, 25, 27, 28, 29, 40, 31, 33, 35, 36, 37, 38, 39, 41, 42, 44, 45, and 46 as shown in SEQ ID NO: 196, 198, 200, 202, 204, 206, 208, 210, 212, 214, 216, 218, 223 & 224, 226, 228, 230, 232, 234, 236, 238, 240, 242, 244, 246, 248, 250, 252, 254, 358, 257, 259, 261, 263, 267, 269, 271, 273, and 275, respectively, are contacted with a test compound. The amount of said one or more TEM proteins in said cells is determined. A test compound is identified as a candidate drug for treating tumors if it decreases the amount of one or more TEM proteins in said cells. Optionally the cells are endothelial cells. Alternatively or additionally, the cells are recombinant host cells which are transfected with an expression construct which encodes said one or more TEMs. Alternatively, a test compound which increases the amount of one or more TEM proteins in said cells is identified as a candidate drug for treating wound healing.

According to another aspect of the invention a method is provided to identify candidate drugs for treating tumors. Cells which express one or more TEM proteins selected from the group consisting of: 1, 2, 3, 4, 5, 6, 7, 8, 9, 10, 11, 12, 14, 15, 16, 17, 19, 20, 21, 22, 24, 25, 27, 28, 29, 40, 31, 33, 35, 36, 37, 38, 39, 41, 42, 44, 45, and 46 as shown in SEQ ID NO: 196, 198, 200, 202, 204, 206, 208, 210, 212, 214, 216, 218, 223 & 224, 226, 228, 230, 232, 234, 236, 238, 240, 242, 244, 246, 248, 250, 252, 254, 358, 257, 259, 261, 263, 267, 269, 271, 273, and 275, respectively, are contacted with a test compound. Activity of said one or more TEM proteins in said cells is determined. A test compound is identified as a candidate drug for treating tumors if it decreases the activity of one more TEM proteins in said cells. Optionally the cells are endothelial cells. Alternatively or additionally, the cells are recombinant host cells which are transfected with an expression construct which encodes said one or more TEMs. Optionally the cells are endothelial cells. If a test compound increases the activity of one more TEM proteins in said cells it can be identified as a candidate drug for treating wound healing.

An additional aspect of the invention is a method to identify candidate drugs for treating patients bearing tumors. A test compound is contacted with recombinant host cells which are transfected with an expression construct which encodes one or more TEM proteins selected from the group consisting of 2, 3, 4, 5, 6, 7, 8, 9, 10, 11, 12, 14, 15, 16, 17, 19, 20, 21, 22, 24, 25, 27, 28, 29, 40, 31, 33, 35, 36, 37, 38, 39, 41, 42, 44, 45, and 46 as shown in SEQ ID NO: 198, 200, 202, 204, 206, 208, 210, 212, 214, 216, 218, 223 & 224, 226, 228, 230, 232, 234, 236, 238, 240, 242, 244, 246, 248, 250, 252, 254, 358, 257, 259, 261, 263, 267, 269, 271, 273, and 275, respectively. Proliferation of said cells is determined. A test compound which inhibits proliferation of said cells is identified as a candidate drug for treating patients bearing tumors. A test compound which stimulates proliferation of said cells is identified as a candidate drug for promoting neoangiogenesis, such as for use in wound healing.

Another embodiment of the invention provides a method to identify candidate drugs for treating tumors. Cells which express one or more NEM genes selected from the group consisting of: 14, 22, 23, and 33 as shown in SEQ ID NO: 278, 282, 284, and 288, respectively, are contacted with a test compound. Expression of said one or more NEM genes is determined by hybridization of mRNA of said cells to a nucleic acid probe which is complementary to said mRNA. A test compound is identified as a candidate drug for treating tumors if it increases expression of said one or more NEM genes. Optionally the cells are endothelial cells. Alternatively or additionally, the cells are recombinant host cells which are transfected with an expression construct which encodes said one or more NEMs.

According to another aspect of the invention a method is provided to identify candidate drugs for treating tumors. Cells which express one or more NEM proteins selected from the group consisting of: 14, 22, 23, and 33 as shown in SEQ ID NO: 279, 283, 285, 286, 287, and 289, are contacted with a test compound. The amount of said one or more NEM proteins in said cells is determined. A test compound is identified as a candidate drug for treating tumors if it increases the amount of one more NEM proteins in said cells. Optionally the cells are endothelial cells. Alternatively or additionally, the cells are recombinant host cells which are transfected with an expression construct which encodes said one or more NEMs.

An additional aspect of the invention is a method to identify candidate drugs for treating tumors. Cells which express one or more NEM proteins selected from the group consisting of: 14, 22, 23, and 33 as shown in SEQ ID NO: 279, 283, 285, 286, 287, and 289, are contacted with a test compound. Activity of said one or more NEM proteins in said cells is determined. A test compound is identified as a candidate drug for treating tumors if it increases the activity of said one or more NEM proteins in said cells. Optionally the cells are endothelial cells. Alternatively or additionally, the cells are recombinant host cells which are transfected with an expression construct which encodes said one or more NEMs.

Still another embodiment of the invention provides a method to identify candidate drugs for treating patients bearing tumors. A test compound is contacted with recombinant host cells which are transfected with an expression construct which encodes one or more NEM proteins selected from the group consisting of 14, 22, 23, and 33 as shown in SEQ ID NO: 279, 283, 285, 286, 287, and 289. Proliferation of said cells is determined. A test compound which stimulates proliferation of said cells is identified as a candidate drug for treating patients bearing tumors.

Another aspect of the invention is a method for identifying endothelial cells. One or more antibodies which bind specifically to a TEM or NEM protein selected from the group consisting of TEM: 2, 3, 4, 5, 6, 7, 8, 9, 10, 11, 12, 14, 15, 16, 17, 19, 20, 21, 22, 24, 25, 27, 28, 29, 30, 31, 33, 35, 36, 37, 38, 39, 41, 42, 44, 45, and 46 as shown in SEQ ID NO: 198, 200, 202, 204, 206, 208, 210, 212, 214, 216, 218, 223 & 224, 226, 228, 230, 232, 234, 236, 238, 240, 242, 244, 246, 248, 250, 252, 254, 358, 257, 259, 261, 263, 267, 269, 271, 273, and 275 and NEM 14, 22, 23, and 33 as shown in SEQ ID NO: 279, 283, 285, 286, 287, and 289, is contacted with a population of cells. Cells in the population which have bound to said antibodies are detected. Cells which are bound to said antibodies are identified as endothelial cells. Optionally cells which have bound to said antibodies are isolated from cells which have not bound.

Still another aspect of the invention is a method for identifying endothelial cells. One or more nucleic acid hybridization probes which are complementary to a TEM or NEM gene nucleic acid sequence selected from the group consisting of TEM: 2, 3, 4, 5, 6, 7, 8, 9, 10, 11, 12, 14, 15, 16, 17, 19, 20, 21, 22, 24, 25, 27, 28, 29, 30, 31, 33, 35, 36, 37, 38, 39, 41, 42, 44, 45, and 46 as shown in SEQ ID NO: 198, 200, 202, 204, 206, 208, 210, 212, 214, 216, 218, 223 & 224, 226, 228, 230, 232, 234, 236, 238, 240, 242, 244, 246, 248, 250, 252, 254, 358, 257, 259, 261, 263, 267, 269, 271, 273, and 275 and NEM 14, 22, 23, and 33 as shown in SEQ ID NO: 279, 283, 285, 286, 287, and 289, is contacted with nucleic acids of a population of cells. Nucleic acids which have specifically hybridized to said nucleic acid hybridization probes are detected. Cells whose nucleic acids specifically hybridized are identified as endothelial cells.

Yet another embodiment of the invention is a method of inhibiting neoangiogenesis. An effective amount of an isolated molecule comprising an antibody variable region which specifically binds to an extracellular domain of a mouse TEM protein selected from the group consisting of: 1, 2, 3, 9, 17, and 19, as shown in SEQ ID NO: 291, 293, 299, 295, 297, and 301, respectively, is administered to a subject in need thereof. Neoangiogenesis is thereby inhibited. The subject may be a mouse, may bear a vascularized tumor, may have polycystic kidney disease, may have diabetic retinopathy may have rheumatoid arthritis, or may have psoriasis, for example.

These and other embodiments which will be apparent to those of skill in the art upon reading the specification provide the art with reagents and methods for detection, diagnosis, therapy, and drug screening pertaining to neoangiogenesis and pathological processes involving or requiring neoangiogenesis.

BRIEF DESCRIPTION OF THE DRAWINGS

FIG. 2A-2D. Purification of Endothelial Cells (ECs) from human normal and malignant tissue. (FIG. 2A) Vessels (red) of frozen sections were stained by immunofluorescence with the P1H12 monoclonal antibody (Chemicon, Temecula, Calif.) and detected using a biotinylated goat anti-mouse IgG secondary antibody followed by rhodamine-linked strepavidin. The region stained is from within the lamina propria of normal colonic mucosa. Note that the larger vessels (arrowheads) and capillaries (arrows) are positive, and staining of hematopoietic cells was undetectable. E-cadherin positive epithelial cells (green) at the edge of the crypt were simultaneously visualized using a rabbit polyclonal antibody (Santa Cruz, Santa Cruz, Calif.), followed by a goat anti-rabbit IgG secondary antibody labelled with alexa (Molecular Probes, Eugene, Oreg.). Sections were imaged at 60× magnification using confocal microscopy. (FIG. 2.C) RT-PCR analysis used to assess the purity of the EC preparations. Semiquantitative PCR analysis was performed on cDNA generated either directly from colorectal cancer tissue (unfractionated tumor) or from purified ECs isolated from normal colonic mucosa (normal EC fraction) or colorectal cancer (tumor EC fraction). PCR amplification of the epithelial specific marker cytokeratin 20 (CK20), demonstrated its expression was limited to the unfractionated tumor. Two endothelial specific markers, vWF and VE-cadherin (VE-Cad) showed robust amplification only in the endothelial fractions, validating the purity and enrichment protocol shown in (FIG. 2.B). The ubiquitous housekeeping enzyme GAPDH was observed in all samples. No signal was detected in the no-template (NT) control. cDNA templates were diluted 1:10, 1:100, 1:1000, 1:4000, and 1:40,000 as indicated by the declining wedge. (FIG. 2.D) The relative expression level of select genes was determined by measuring the tag abundance from several SAGE libraries combined into four groups. The first was composed of ~193,000 tags from the two in vivo-derived EC preparations (Endothelial Cell Fraction) while the second contained a single library of ~57,000 tags containing macrophages and other leukocytes derived from the negative selection (Hematopoietic Fraction). The fourth library contained ~401,000 tags from cultured HUVEC and HMVEC (Endothelial Cells in Culture), and the fourth consisted of ~748,000 tags from 6 colon cancer cell lines in culture (Epithelial Cells). After normalization, the library with the highest tag number for each marker was given a value of 100%, and the corresponding relative expression levels of the remaining 3 libraries was plotted on the ordinate. Note the high level of CD31 present on hematopoietic cells, the likely cause of the impurity of the initial endothelial selection, compared with the selectivity of P1H12.

(FIG. 4A) RT-PCR analysis confirmed the tumor specific expression of selected novel TEMs. Semiquantitative PCR analysis was performed on cDNA generated either from purified epithelial cells as a negative control (Control) or from purified ECs isolated from normal colonic mucosa (Normal ECs) or colorectal cancer (Tumor ECs) from two different patients. Two endothelial specific markers, vWF and PEM6 showed robust amplification only in the endothelial fractions whereas the ubiquitous housekeeping enzyme GAPDH was observed in all samples. TEM1 (BSC-TEM1), TEM 17 (BSC-TEM7) and TEM22 (BSC-TEM9) were specifically expressed in tumor compared to normal ECs. The cDNA template was diluted 1:10, 1:100, 1:1000, and 1:10,000 as indicated by the declining wedge. (FIG. 4B-4J) The endothelial origin of TEMs identified by SAGE was confirmed using in situ hybridization as in FIG. 3. Expression of TEM 1 (BSC-TEM1) (FIG. 4B) and TEM17 (BSC-TEM7). (FIG. 4C) was demonstrated to be highly specific to the ECs in colorectal cancers; sections were imaged in the absence of a counterstain to show the complete lack of detectable expression in the non-endothelial cells of the tumor. Expression of TEM17 (BSC-TEM7) in ECs was demonstrated in a metastatic liver lesion from a primary colorectal cancer (FIG. 4D), a lung (FIG. 4E), breast (FIG. 4F), pancreatic (FIG. 4G) and brain cancer (FIG. 4H), as well as in a sarcoma (FIG. 4I). TEM 17 (BSC-TEM7) was also localized to vessels during normal physiological angiogenesis of the corpus luteum (FIG. 4J).

DETAILED DESCRIPTION OF THE INVENTION

Figure 1:
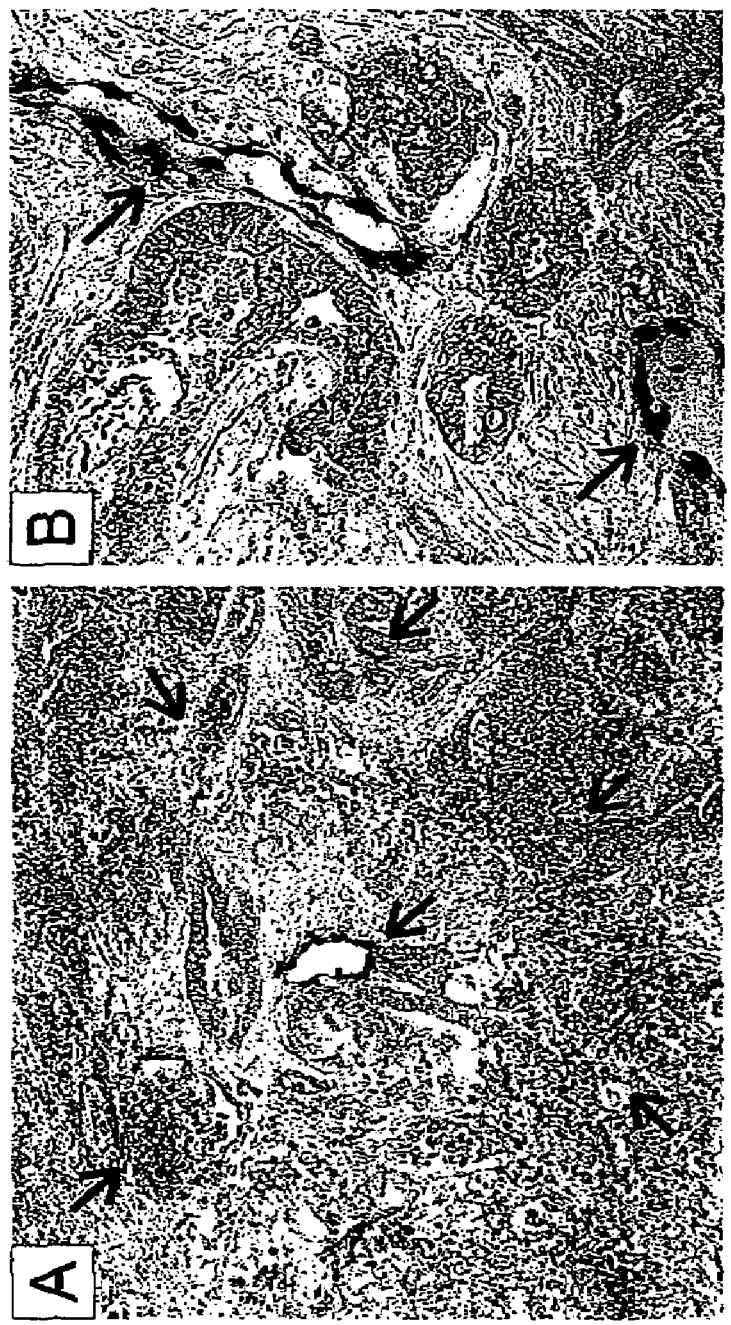
FIG. 1A-1B. vWF expression in colorectal cancers. vWF (red stain) was detected in vessels by in situ hybridization. At low power magnification (FIG. 1.A) vessels were often surrounded by a perivascular cuff of viable cells (red arrows), with a ring of necrotic cells evident at the periphery (black arrows). At high power magnification (FIG. 1.B) the expression of vWF (red) was clearly localized to the vessels. Sections were counterstained with methyl green.

We identified 46 human genes that were expressed at significantly higher levels (>10-fold) in tumor endothelium than in normal endothelium, and 33 genes that were expressed at significantly lower levels in human tumor versus normal endothelium. See Tables 2 and 4, respectively. Most of these genes were either not expressed or expressed at relatively low levels in Endothelial Cells (ECs) maintained in culture. Moreover, we identified 93 genes which are expressed in both normal and tumor human endothelium. Interestingly, the tumor endothelium genes were expressed in all tumors tested, regardless of its tissue or organ source. Most tumor endothelium genes were also expressed in corpus luteum and wounds.

As the work has progressed, we have refined and classified our original 46 tumor endothelial markers. We have named these markers TEMs and renumbered them consecutively by the prevalence of their tags in our SAGE analysis. Originally we had not used a consecutive numbering system. Our non-consecutive numbering system has been renamed as BSC-TEMs. For most of the original 46 SAGE Tags, we now provide full-length nucleic acid and protein sequence. In some cases, the sequences were obtained through the public databases, in others the sequences were obtained by cloning and through the use of gene prediction tools. In some cases, we found SAGE Tags corresponding to genes having different splice varients or with known polymorphisms. For example, in one case the SAGE Tag BSC-TEM3 has been found to hybridize to an alternatively spliced form of the transcript encoding BSC-TEM7. The proteins encoded by the two transcripts are the same; therefore they are cumulatively called TEM7. A highly related sequence was found via homology searches, BSC-TEM7R. This paralog sequence is now called TEM3. See Table 2, which follows, showing tumor endothelial markers by order of prevalence (except for TEM 3). Column 1 indicates the prevalence number. Column 2 indicates the original nomenclature. Column 3 indicates the short tags. Column 4 indicates the long tags. Column 5 indicates the accession number in GenBank. Column 6 indicates the sequence identifiers for the short tag, the long tag, the full nucleic acid, and the protein. Column 7 provides a functional description, which is expanded below in the text.

| | | | | | | |
|---|---|---|---|---|---|---|
| TEM 1 | BSC-TEM1 | GGGGCTGCC CA | GGGGCTGCCCAGCT GA | NM020404 | SEQ ID NO: 94, 309, 195, 196 | tumor endothelial marker 1 precursor |

-continued

| | | | | | |
|---|---|---|---|---|---|
| TEMBSC-2 TEM2 | GATCTCCGT GT | | | SEQ ID NO: 95, 197, 198 | sapiens tumor endothelial marker 2 (BSC-TEM2) mRNA/mouse Ras, dexa-methasone-induced 1 (RASD1), mRNA |
| TEMBSC-3 TEM7R | | | | SEQ ID NO: 199, 200 | human ortholog of mouse paralog of mouse TEM-7 |
| TEM 4 | CTTTCTTTGA G | CTTTCTTTGAGTTTT AA | AB034203 | SEQ ID NO: 97, 311, 201, 202 | *Homo sapiens* dickkopf-3 (DKK-3) mRNA, |
| TEMBSC-5 TEM4 | TATTAACTCT C | TATTAACTCTCTTTG GA | | SEQ ID NO: 98, 312, 203, 204 | Tumor endothelial marker 4 |
| TEM 6 | CAGGAGACC CC | CAGGAGACCCCAGG CCC | X57766 | SEQ ID NO: 99, 314, 205, 206 | Human stromelysin-3 mRNA. |
| TEM 7 | GGAAATGTC AA | GGAAATGTCAGCAA GTA | BC002576 | SEQ ID NO: 100, 315, 207, 208 | matrix metalloproteinase 2 (gelatinase A, 72kD gelatinase, 72kD type IV collagenase) |
| TEM 8 | CCTGGTTCA GT | | | SEQ ID NO: 101, 316, 209, 210 | HeyL transcription factor |
| TEMBSC-9 TEM5 | TTTTTAAGAA C | TTTTTAAGAACTCGG GT | | SEQ ID NO: 102, 317, 211, 212 | |
| TEM 10 | TTTGGTTTTC C | TTTGGTTTTCCAAAA GA | J03464, M18057, X02488 | SEQ ID NO: 103, 319, 213, 214 | Human collagen alpha-2 type I mRNA, complete cds, clone pHCOL2A1. |
| TEM 11 | ATTTTGTATG A | ATTTTGTATGATTTT TA | NM_00250 8 | SEQ ID NO: 104, 321, 215, 216 | nidogen/entactin |
| TEM 12 | ACTTTAGATG G | ACTTTAGATGGGAA GCC | X52022 | SEQ ID NO: 105, 322, 217, 218 | *H. sapiens* RNA for type VI collagen alpha3 chain. |
| TEM 13 | GAGTGAGAC CC | GAGTGAGACCCAGG AGC | M11749 | SEQ ID NO: 106, 324, 219, 220 | Human Thy-1 glycoprotein gene, complete cds. |
| TEM 14 | GTACACACA CC | GTACACACACCCCC ACC | | SEQ ID NO: 107, 325, 221, 223 | Cystatin SN |
| TEM 14 | GTACACACA CC | GTACACACACCCCC ACC | X54667 | SEQ ID NO: 107, 325, 222, 224 | *H.sapiens* mRNA for cystatin S. |
| TEM 15 | CCACAGGGG AT | CCACAGGGGATTCT CCT | NM_00009 0 | SEQ ID NO: 108, 327, 225, 226 | Human mRNA 3' region for pro-alpha1 (III) collagen. |
| TEMBSC-16 TEM6 | TTAAAGTCA C | TTAAAAGTCACTGTG CA | | SEQ ID NO: 109, 328, 227, 228 | |

-continued

| | | | | | |
|---|---|---|---|---|---|
| TEMBSC-17 TEM7 | ACAGACTGTTA | ACAGACTGTTAGCCAAG | AF279144 | SEQ ID NO: 110, 329, 229, 230 | Human Tumor endothelial marker 7 |
| TEM 18 | CCACTGCAACC | | | SEQ ID NO: 111 | |
| TEMBSC-19 TEM8 | CTATAGGAGAC | | | SEQ ID NO: 112, 330, 231, 232 | |
| TEM 20 | GTTCCACAGAA | | NM_000089 | SEQ ID NO: 113, 233, 234 | collagen, type I, alpha 2 (COL1A2 |
| TEM 21 | TACCACCTCCC | TACCACCTCCCTTTCCT | | SEQ ID NO: 114, 331, 235, 236 | Homo sapiens mRNA; cDNA DKFZp762B245 (from clone DKFZp762B245); |
| TEMBSC-22 TEM9 | GCCCTTTCTCT | GCCCTTTCTCTGTAGTT | NM_006039 | SEQ ID NO: 115, 334, 237, 238 | endocytic receptor (macrophage mannose receptor family) (KIAA0709), |
| TEM 23 | TTAAATAGCAC | TTAAATAGCACCTTTAG | | SEQ ID NO: 116, 335 | no match |
| TEM 24 | AGACATACTGA | AGACATACTGACAGAAT | NM_022648 | SEQ ID NO: 117, 336, 239, 240 | Homo sapiens mRNA; cDNA DKFZp434G162 (from clone DKFZp434G162); |
| TEM 25 | TCCCCCAGGAG | TCCCCCAGGAGCCACCG | L35279, NM_006129 | SEQ ID NO: 118, 338, 241, 242 | Homo sapiens (clone kT2) bone morphogenetic protein-1 (BMP-1) mRNA |
| TEM 26 | AGCCCAAAGTG | | | SEQ ID NO: 119 | No Match |
| TEM 27 | ACTACCATAAC | | NM_003062 | SEQ ID NO: 120, 243, 244 | Homo sapiens mRNA for MEGF5, partial cds. |
| TEM 28 | TACAAATCGTT | TACAAATCGTTGTCAAA | NM_014859 | SEQ ID NO: 121, 339, 245, 246 | Homo sapiens mRNA for KIAA0672 protein, complete cds. |
| TEM 29 | TTGGGTGAAAA | | | SEQ ID NO: 122, 247, 248 | ESTs (2 unigene clusters) |
| TEM 30 | CATTATCCAAA | CATTATCCAAAAACAAT | THC534029, X68742, AI262158, AI88747, AI394565, AA679721 | SEQ ID NO: 123, 340, 249, 250 | integrin, alpha 1 |
| TEM 31 | AGAAACCACGG | AGAAACCACGGAAATGG | NM_001845 | SEQ ID NO: 124, 341, 251, 252 | hypothetical protein KIAA1164 |
| TEM 32 | ACCAAAACCAC | | | SEQ ID NO: 125 | no match |
| TEM 33 | TGAAATAAAC | | NM_000255 | SEQ ID NO: 126, 253, 254 | methylmalonyl Coenzyme A mutase |
| TEM 34 | TTTGGTTTCC | | | SEQ ID NO: 127 | no match |

-continued

| | | | | | |
|---|---|---|---|---|---|
| TEM 35 | GTGGAGACGGA | GTGGAGACGGACTCTGT | ESTAI186535 | SEQ ID NO: 128 345, 255, 358 | est |
| TEM 36 | TTTGTGTTGTA | TTTGTGTTGTATATTTA | NM_004370 | SEQ ID NO: 129, 346, 256, 257 | est |
| TEM 37 | TTATGTTTAAT | TTATGTTTAATAGTTGA | NM_002345 | SEQ ID NO: 130, 347, 258, 259 | Human lumican mRNA, complete cds. |
| TEM 38 | TGGAAATGAC | TGGAAATGACCCAAAAA | NM_000088 | SEQ ID NO: 131, 348, 260, 261 | collagen type1 alpha1 |
| TEM 39 | TGCCACACAGT | TGCCACACAGTGACTTG | NM_003239 | SEQ ID NO: 132, 350, 262, 263 | Human transforming growth factor-beta 3 (TGF-beta3) mRNA, complete |
| TEM 40 | GATGAGGAGAC | GATGAGGAGACTGGCAA | | SEQ ID NO: 133, 351, 264, 265 | collagen, type I, alpha 2 |
| TEM 41 | ATCAAAGGTTT | ATCAAAGGTTTGATTTA | | SEQ ID NO: 134, 352, 266, 267 | est |
| TEM 42 | AGTCACTAGT | AGTCACATAGTACATAA | NM_025226 | SEQ ID NO: 135, 353, 268, 269 | ESTs |
| TEM 43 | TTCGGTTGGTC | TTCGGTTGGTCAAAGAT | | SEQ ID NO: 136, 354 | No match |
| TEM 44 | CCCCACACGGG | CCCCACACGGGCAAGCA | NM_018354v | SEQ ID NO: 137, 355, 270, 271 | *Homo sapiens* cDNA FLJ11190 fis, clone PLACE1007583. |
| TEM 45 | GGCTTGCCTTT | GGCTTGCCTTTTTGTAT | NM_000366 | SEQ ID NO: 138, 356, 272, 273 | est |
| TEM 46 | ATCCCTTCCCG | ATCCCTTCCCGCCACAC | NM_002688 | SEQ ID NO: 139, 357, 274, 275 | *Homo sapiens* mRNA for peanut-like protein 1, PNUTL1 (hCDCrel-1). |

The studies described below provide the first definitive molecular characterization of ECs in an unbiased and general manner. They lead to several important conclusions that have direct bearing on long-standing hypotheses about angiogenesis. First, it is clear that normal and tumor endothelium are highly related, sharing many endothelial cell specific markers. Second, it is equally clear that the endothelium derived from tumors is qualitatively different from that derived from normal tissues of the same type and is also different from primary endothelial cultures. Third, these genes are characteristically expressed in tumors derived from several different tissue types, documenting that tumor endothelium, in general, is different from normal endothelium. Fourth, the genes expressed differentially in tumor endothelium are also expressed during other angiogenic processes such as corpus luteum formation and wound healing. It is therefore more appropriate to regard the formation of new vessels in tumors as "neoangiogenesis" rather than "tumor angiogenesis" per se. This distinction is important from a variety of perspectives, and is consistent with the idea that tumors recruit vasculature using much of, or basically the same signals elaborated during other physiologic or pathological processes. That tumors represent "unhealed wounds" is one of the oldest ideas in cancer biology.

The nature and precise biological function of many of the Tumor Endothelial Markers (TEMs) identified here are unknown. Of the previously characterized genes shown in Table 2, it is intriguing that several encode proteins involved in extracellular matrix formation or remodelling (TEM 6, TEM 6, TEM 10, TEM 7, TEM 11, TEM 12, TEM 14, TEM 20, TEM 24, TEM 25, TEM 27, TEM 37, TEM 38, and TEM 40.) Deposition of extracellular matrix is likely critical to the growth of new vessels. Finally, it is perhaps not surprising that so many of the endothelial-specific transcripts identified here, whether expressed only in neovasculature or in endothelium in general, have not been previously characterized, and some are not even represented in EST databases. In part, this may be due to the fact that the EST databases are heavily biased toward certain tissues, but moreover, may be due to the fact that even in highly vascularized tissues endothelial cells are still a relatively small proportion of the population. Thus, the sensitivity of the SAGE method is a particularly appropriate tool.

Sequence and literature study has permitted the following identifications to be made among the family of TEM proteins. TEM proteins have been identified which contain transmembrane regions. These include TEM 1, TEM 3, TEM 9, TEM 13, TEM 17, TEM 19, TEM 22, TEM 30, and TEM 44. TEM proteins have been identified which are secreted proteins, including TEM 4, TEM 6, TEM 7, TEM 10, TEM 12, TEM 14, TEM 20, TEM 25, TEM 27, TEM 31, TEM 36, TEM 37, TEM 38, and TEM 39. HeyL (TEM 8) is a transcription factor which may be involved in regulating TEMs as one or more groups. The protein corresponding to the tag for TEM44 was found in the public databases, but no biological function has yet been ascribed to it.

TEM 1 has been named endosialin in the literature. It has a signal sequence at amino acids 1-17 and a transmembrane domain at amino acids 686-708. Thus it is a cell surface protein. Its extracellular domain is at resiudes 1-685. Endosialin may be involved in endocytosis. The mouse ortholog is predicted to have a signal peptide at residues 1-21.

TEM 2 is a dexamethasone induced, as related protein homolog of 266 amino acids. It has neither a signal sequence nor a transmembrane domain. Thus it is neither a cell surface nor a secreted protein. TEM 2 plays a role in signal transduction. It regulates alterations in cell morphology, proliferation, and cell-extracellular matrix interactions.

TEM 3 (originally termed TEM 7R) has both a signal sequence (at residues 1-24 or 1-30) and a transmembrane domain (at residues 456-477). Thus it is a cell surface protein. The portion of the protein which is extracellular is at amino acids 1-455. TEM 3 has domains with homology to integrins, plexin, and adhesion molecules. TEM 3 may regulate GTPases that control signal transduction pathways linking plasma membrane receptors to the actin cytoskeleton. In the mouse ortholog, the signal peptide is predicted to be residues 1-30.

TEM 4 is also known as DKK-3. It has a signal sequence (residues1-16), suggesting that is a secreted protein. TEM 4 regulates wnt signaling, and it may be involved in vasculogenesis and wnt-dependent signaling for endothelial growth. TEM 4 is an inhibitor of Wnt oncogene and such inhibition can be determined by assay. Tsuji et al., Biochem. Biophys. Res. Comm. 268: 20-4, 2000.

TEM 5 appears to be neither secreted nor a cell surface protein. TEM 5 appears to be a component of a G protein—GTPase signaling pathway.

TEM 6 is also known as stromelysin-3/Matrix metalloproteinase 11 (MMP-11). It has a signal sequence at residues 1-31, but no transmembrane domain. It has an alternative signal peptide splice site at residues 108-109. Thus it appears to be a secreted protein. TEM 6 belongs to the zinc metaloprotease family, also known as the matrixin subfamily. TEM 6 is expressed in most invasive carcinomas. Alpha 1—protease inhibitor is a natural substrate of MMP 11. TEM 6 degrades extracellular matrix proteins such as collagen and is involved in extracellular matrix remodeling and cell migration. Stromelysin can be assayed using a casein-resorufin substrate, for example. See Tortorella and Arner, Inflammation Research 46 Supp. 2: S122-3, 1997.

TEM 7 is a protein of many names, also being known as matrix metalloproeinase 2, gelatinase A, and 72 KD type IV collagenase. TEM 7 has a signal sequence at residues 1-26 and is a secreted protein. Like TEM 6, TEM 7 belongs to the matrixin subfamily (zinc metalloproteinases). TEM 7 cleaves gelatin type I, collagen type I, IV, V VII and X. TEM 7 associates with integrin on the surface of endothelial cells and promotes vascular invasion. TEM 7 is involved in tissue remodeling. TEM 7 can be assayed using zymography or quenched fluorescent substrate hydrolysis, for example. Garbett, et al., Molecular Pathology 53: 99-106, 2000. A fluorogenic matrix metalloproteinase substrae assay can also be used which employs methoxycoumarin containing septapeptide analog of the alpha2(I) collagen cleavage site. See Bhide et al., J. Periodontology 71:690-700, 2000.

TEM 8 is HEYL protein. It has neither a signal sequence nor a transmembrane domain. It is related to the hairy/Enhancer of split genes. TEM 8 is likely a nuclear protein, having a role as a transcription factor. TEM 8 belongs to a new class of Notch signal tranducers and plays a key role in various developmental processes, such as vascular development, somatogenesis and neurogenesis. SNP's at residues 615 and 2201 have Cytosine bases. Notch 3 mutations underlie the CADASIL vascular disorder. See *Mech Dev* 2000 November; 98 (1-2):175.

TEM 9 is a G-protein coupled receptor homolog, having both a signal sequence at residues 1-26 and 7 transmembrane domains. Thus it is a cell surface protein. Its extracellular region resides in amino acids 1-769. Its transmembrane domains are at residues 817-829 (TM2 and TM3), residues 899-929 (TM4 and TM5), and residues 1034-1040 (TM6 and TM7). TEM 9 acts as a G-protein coupled receptor with extracellular domains characteristic of cell adhesion proteins. One of its splice variants may function as a soluble receptor. TEM 9 may regulate cell polarity and cell migration. It may be involved in exocytosis based on latrophilin function. The mouse ortholog has a predicted signal peptide at residues 1-29.

TEM 10 is collagen type I, alpha2 (COL1A2), which has a signal sequence at residues 1-22. It is an extracellular matrix (ECM) protein which is secreted subsequent to synthesis. TEM 10 interacts with a number of proteins including other ECM proteins, certain growth factors, and matrix metalloproteases. TEM 10 is required for the induction of endothelial tube formation and is involved in tissue remodeling. A variant at nucleotide 3233 which substitutes an A, is associated with osteogenesis imperfecta type IV. A variant at nucleotide 4321 substituting an A retains a wild type phenotype. Nucleotide 715 is a site of a polymorphism. Nucleotides 695-748 are deleted in Ehlers-Danos syndrome. Other mutations are associated with idiopathic osteoporosis, and atypical Marfan syndrome. Variants are known at nucleotides 226(T,C), 314(A,C), 385(T,C), 868 (G,A), 907(C,T), 965(A,G), 970(T,A), 1784 (G,C), 2017(T,G), 2172(C,A), 2284(T,C), 2308(T,C), 2323(T,G), 2344(T,G), 2604(G,A), 2974(A,T), 2903(A,G), 2995(C,T), 3274(C,T), 3581(A,C), 3991(A,C), 4201(G,T), 4434(C,T), 4551(A,C), 4606(C,A), 4947(T,C), 4978(C,T), 4982(G,T), 5051(G,T). PolyA sites are located at nucleotides 4450, 4550, 4885, and 5082. PolyA signals are located at 4420-4424, 4515-4520, 4529-4534, 4866-4871, 5032-5037, 5053-5058. TEM 10, 20, and 40 derive from the same gene but are different isoforms having different lengths.

TEM 11 is Nidogen/Entactin. It is a secreted protein which has a signal sequence at residues 1-28. TEM 11 is an extracellular matrix protein which is a component of a basement membrane. TEM 11 binds to laminin and collagen IV and other extracellular matrix proteins. TEM 11 regulates capillary formation and is involved in tissue remodelling. Variations have been observed at nucleotides 4265(T,C), 4267(G,C,T), and 4738(T,G). Nidogen can be assayed by its effect on the morphology of astrocytes. See Grimpe et al., GLIA 28:138-49, 1999.

TEM 12 is the alpha 3 chain of collagen type VI. It has a signal sequence at residues 1-25. A secreted protein, TEM 12 is an extrallcellular matrix protein. TEM 12 has a splice variant. TEM 12 is a major constituent of vascular subendothelium and is involved in tissue remodeling. It regulates platelet activation and aggregation. Alternatively spliced domains are located at nucleotides 347-964, 965-1567, 2153-3752, and 4541-5041.

TEM 13 is also known as Thy-1 glycoprotein. It has both a signal sequence (at residues 1-19) and a transmembrane domain (at residues 143-159). Residues 131-161 are removed in a matured form of the protein. The extracellular region of the protein is resudes 1-142 or residues 1-130. TEM 13 has a glycosyl phosphatidylinositol (GPI) anchor at residue 130 anchoring it to the membrane. TEM 13 is detectale in its soluble form in human serum. TEM 13 is reported to be a marker for activated endothelial cells (a marker of adult but not embryonic angiogenesis). TEM 13 on vascular endothelial cells may function as a possible vascular permeability modulator. Antibody to Thy-1 is a mitogenic signal for the CD4+CD45+ and CD8+CD45+ cells, but fails to induce proliferation in the CD45− T cells. Pingel et al., International Immunology 6:169-78, 1994. Thy-1 can be assayed as an inhibitor of such signal.

TEM 14 is also known as cystatin S. It is a secreted protein with a signal sequence at residues 1-20 and an extracellular region at residues 1-141. It is a cysteine protease inhibitor. TEM 14 may regulate cysteine protease function involved in angiogenesis and tissue remodeling. TEM14 is an inhibitor of the activity of papain and such inhibition can be assayed. Hiltke et al., J. Dental Research 78:1401-9, 1999.

TEM 15 is collagen type III, alpha 1 (COL3A1). It has a signal sequence (residues 1-23) and is secreted. Type III collagen binds to von Willebrand factor. It is involved in cell-cell adhesion, proliferation, and migration activities. Variants at nucloetides 2104(C,A), 2194(G,A), 2346(C,T), 2740(C,T), 3157(T), 3468(G), 3652(T), 3666(C), 3693(C), 3755(G), 3756(T), 3824(C), 4546(A, G), 4661(G), 4591(C, T), 4665(C), 5292(C), 5293(C), and 5451(A) have been observed.

TEM 16 is a tensin homolog which is apparently an intracellular protein. It may have splice variants or isoforms. One form with 1704 amino acids has a region at the N-terminal domain which is similar to a tumor suppressor protein, phosphatase and tensin homolog (PTEN). Tensin is a focal adhesion molecule that binds to actins and phosphorylated proteins. It is involved in cell migration linking signal tranduction pathways to the cytoskeleton. PTEN regulates tumor induced angiogenesis.

TEM 17 (BSC-TEM 7) has a signal sequence which includes residues 1-18 and a transmembrane domain at residues 427-445. It is a cell surface marker with an extracellular region comprising residues 1-426. It has homologs in both mouse and C. elegans. Residues 137-244 share weak homology with nidogen; residues 280-344 share homology to PSI domains found in plexin, semaphorins and integrin beta subunits. Variants have been observed at nucleotides 1893(A,G), 1950(C,G), 2042(A,G), and 2220(G,A). In mouse TEM 17 the signal sequence includes residues 1-19.

TEM 19 was originally reported to be tumor endothelial marker 8, i.e., BSC-TEM 8. It has a signal sequence at residues 1-27 and a transmembrane domain at residues 322-343. It is a cell surface protein having an extracellular region at residues 1-321.TEM 19 has a von Willebrand Factor (vWF) A domain at residues 44-216; a domain at residues 34-253 which is found in leukointegrin alpha D chain; and a domain at residues 408-560 found in PRAM-1 or adaptor molecule-1 of the vinculin family. TEM 19's function is adhesion related. vonWillibrand Factor domains are typically involved in a variety of functions including vascular processes. TEM 19 may play a role in the migration of vascular endothelial cells. The mouse ortholog has a predicted signal peptide at residues 1-27.

TEM 20 is collagen type I, alpha 2 (COL1A2). It has a signal sequence at residues 1-22 and is a secreted extracellular matrix protein. TEM 20 induces endothelial tube formation in vitro and is involved in tissue remodeling. Variants have been observed at nucleotides 226(T,C), 314 (A,C), 385(T,C), 868 (G,A), 907(C,T), 965(A,G), 970(T,A), 1784(G,C), 2017(T,G), 2172(C,A), 2284(T,C), 2308(T,C), 2323(T,G), 2344(T,G), 2604(G,A), 2794(A,T), 2903(A,G), 2995(C,T), 3274(C,T), 3581(A,C), 3991(A,C), 4201(G,T), 4434(C,T), 4551(A,C), 4606(C,A), 4895-4901(—, GGA-CAAC), 4947(T,C), 4978(C,T), 4982(G,T), 5051(G,T).

TEM 21 is a Formin-like protein homolog which is an intracellular protein. Formin related proteins interact with Rho family small GTPases, profilin, and other actin associated proteins. Formin-binding proteins bind to FH1 domains with their WW domains. TEM 21 has a proline rich FH 1 domain at residues 221-449. Formin related proteins play crucial roles in morphogenesis, cell polarity, cytokinesis and reorganization of the actin cytoskeleton. They may also regulate apoptosis, cell adhesion and migration.

TEM 22 is an endocytic receptor in the macrophage mannose receptor family. It has both a signal sequence at residues 1-30 and a transmembrane domain at residues 1415-1435, and resides on the cell surface. Its extracellular domain is amino acids 1-1414. TEM 22 may be present as a soluble (secreted) form and act as an inhibitor. It may bind secreted phopholipase A2 (sPLA2) and mediate biological responses elicited by sPLA2. TEM 22 may have endocytic properties for sPLA2 and mediate endocytosis for endothelial related proteins. It may promote cell adhesion and be involved in cell-cell communication. Variations have been observed at nucleotide 5389 (A, G). TEM 22 mediates uptake of micro-organisms and host-derived glycoproteins. Groger et al., J. Immunology 165:5428-34, 2000.

TEM 24 is tensin, an intracellular protein. It is a focal adhesion molecule that binds to actin filaments and interacts with phosphotyrosine containing proteins. It may mediate kinase signaling activities and regulate cellular transformation. Variations have been observed at nucleotides 2502 (A, G), 2622(A, G), 6027(A, G). TEM24 binds to actin filaments and interacts with phosphotyrosine-containing proteins. Chen et al., Biochem. J. 351 Pt2:403-11, 2000. TEM24 also binds to phosphoinositide3-kinase. Auger et al., J. Bio. Chem. 271:23452-7, 1996 TEM 24 also binds to nuclear protein p130. Lo et al., Bioessays 16:817-23, 1994.

TEM 25 is Bone morphogenic protein 1 (BMP-1) which has a signal sequence at residues 1-22. It is a secreted protein. There are at least 6 isoforms of BMP-1 as well as splice variants which add carboxy terminal CUB domains and an additional EGF domain. TEM 25 is a metalloprotease enzyme. It cleaves the C-terminal propeptide of collagen type I, II and III and laminin 5 gamma 2 proteins that are important for vascular processes. It is involved in cartilage formation. Variations have been observed at nucleotides 3106(C,T), 3248(G,A), 3369(G,A). TEM 25 cleave probiglycan at a single site, removing the propeptide and producing a biglycan molecule with an NH(2) terminus identical to that of the mature form found in tissues. Sctt et al., J. Biol. Chem. 275:30504-11, 2000. Laminin alpha 3 and gamma2 short chains are substraates of TEM 25. Amano et al., J. Biol. Chem. 275:22728-35, 2000.

TEM 27 is known as Slit homolog 3, a secreted protein with a signal sequence at residues 1-27. TEM 27 is a secreted guide protein involved in migration, repulsion and patterning. It interacts with "round about" receptors (Robo receptors). TEM 27 may interact with extracellular matrix (ECM) proteins and is involved in cell adhesion. Variations have been observed at nucleotides 4772 (C,T).

TEM 28 is similar to mouse nadrin (neuron specific GTPase activiating protein). TEM 28 is an intracellular protein with a RhoGAP domain. The RhoGAP domain activates RhoA, Rac 1, and Cdc42 GTPases. It is involved in the reorganization of actin filaments and enhancing exocytosis. It may also be involved in cell signalling. Variations have been observed at nucleotide 3969 (A,C), TEM 29 is protein tyrosine phosphatase type IVA, member 3, isoform 1, an intracellular protein. It has alternate splice variants. TEM 29 belongs to a small class of prenylated protein tyrosine phosphatases (PTPs). It may be membrane associated by prenylation. PTPs are cell signaling molecules and play regulatory roles in a variety of cellular processes and promote cell proliferation. PTP PRL-3 regulates angiotensin—II induced signaling events.

TEM 30 is integrin alpha 1, a cell surface protein having both a signal sequence (residues 1-28) and a transmembrane domain (residues 1142-1164). Its extracellular region includes amino acids 1-1141. TEM 30 is a receptor for laminin and collagen. It mediates a variety of adhesive interactions. TEM 30 is abundantly expressed on microvascular endothelial cells. It stimulates endothelial cell proliferation and vascularization. TEM 30 may regulate angiostatin production. Variations have been observed at nucleotide 418 (C,T). TEM 30 activates the Ras/Shc/mitogen-activated protein kinase pathway promoting fibroblast cell proliferation. It also acts to inhibit collagen and metalloproteinase synthesis. Pozzi et al., Proc. Nat. Acad. Sci. USA 97:2202-7, 2000, TEM 31 is Collagen IV alpha 1 (COL4A1) a secreted protein with a at residues 1-27. TEM 31 is a component of the basement membrane. It binds to alpha3 beta 1integrin and promotes integrin mediated cell adhesion. Non-collagenous domains of type IV subunits are involved in tumoral angiogenesis. TEM 31 is involved in tissue remodeling. Variations have been observed at nucleotide 4470 (C,T).

TEM 33 is methylmalonyl Co-A Mutase a protein which is localized in the mitochondrial matrix. It degrades several amino acids, odd-numbered-acid fatty acids, and cholesterol to the tricarboylic acid cycle. A defect in TEM 33 causes a fatal disorder in organic acid metabolism termed methylmalonic acidurea. Variations have been observed at nucleotides 1531(G,A), 1671(G,A), 2028(T,C), 2087(G,A), 2359(A,G), 2437(C,A), 2643(G,C), 2702(G,C). TEM 33 converts L-methylmalonyl CoA to succinyl CoA. This reaction can be assayed as is known in the art. See, e.g., Clin. Chem. 41(8 Pt I):1164-70, 1995.

TEM 36 is collagen type XII, alpha1 (COL12A1), an extracellular matrix protein having a signal sequence at residues 1-23 or 24. TEM 36 has von Willebrand Factor (vWF) type A domains, Fibronectin type III domains, and thrombospondin N-terminal like domain. TEM 36 is expressed in response to stress environment. TEM 36 may organize extracellular matrix architecture and be involved in matrix remodeling. There are two isoforms of the protein, a long form and a short form. The short form is missing amino acids 25-1188, and therefore nucleotides 73 to 3564. Both forms share the signal sequence and are therefore both secreted.

TEM 37 is lumican, an extracellular matrix sulfated proteoglycan having a signal sequence at residues 1-18. Lumican interacts with proteins that are involved in matrix assembly such as collagen type I and type VI; it is involved in cell proliferation and tissue morphogenesis. Lumican plays an important role in the regulation of collagen fiber assembly. Variations have been observed at nucleotides 1021(G,T), 1035(A,G), 1209(A,G), 1259(A,C), 1418(C,A), 1519(T,A). TEM 37 is a binding partner of TGF-β. See FASEB J. 15:559-61, 2000. One assay that can be used to determine TEM 37 activity is a collagen fibril formation/sedimentation assay. Svensson et al., FEBS Letters 470:178-82, 2000.

TEM 38 is collagen type I, alpha 1 (COL1A1), an extracellular matrix protein having a signal sequence at residues 1-22. Type I collagen promotes endothelial cell migration and vascularization and induces tube formation and is involved in tissue remodelling. Telopeptide derivative is used as a marker for malignancy and invasion for certain cancer types. Variations have been observed at nucleotides 296(T,G), 1810(G,A), 1890(G,A), 2204(T,A), 3175(G,C), 3578(C,T), 4298(C,T), 4394(A,T), 4410(A,C), 4415(C.A), 4419 (A,T), 4528(C,A), 4572(G,T), 4602(T,C), 5529(T,C), 5670(C,T), 5985(C,T), 6012(C,T).

TEM 39 is transforming growth factor β-3 (TGF-beta3). It has a signal sequence at residues 1-23. It is a secreted protein. TEM 39 regulates cell growth and differentiation. TGF-beta isoforms play a major role in vascular repair processes and remodeling. Variations have been observed at nucleotide 2020(G,T).

TEM 41 is similar to Olfactomedin like protein. It appears to be an intracellular protein, having no obvious predicted signal sequence. Olfactomedin is the major glycoprotein of the extracellular mucous matrix of olfactory neuroepithelium. TEM 41 shares homology with latrophilin (extracellular regions) which has cell-adhesive type domains. TEM 41 may be involved in adhesive function.

TEM 42 is MSTP032 protein, a cell surface protein having a trasmembrane domain at residues 42-61. Its function is unknown and it shares little homology with other proteins. Variations have been observed at nucleotides 418 (A,T), 724(C,A).

TEM 44 is a hypothetical protein FLJ1190 (NM__018354) which has two predicted transmembrane domains at residues 121-143 and 176-197. Residues 144-175 may form an extracellular region. TEM 44's function is not known and shares no homology to other known proteins.

TEM 45 is tropomyosin 1 (alpha), a protein which is intracellular. It forms dimers with a beta subunit. It influences actin function. TEM 45 may be involved in endothelial cell cytoskeletal rearrangement. Variations have been observed at nucleotides 509(A,C), 621(A,C), 635(T,G), 642 (C,G), 1059(G,T).

TEM 46 is peanut-like 1 protein/septin 5, which belongs to the septin family. Proteins in the septin family bind to GTP and phosphatidylinositol 4,5-bisphosphate. They are involved in the signal tranduction cascades controlling cytokinesis and cell division.

NEM 4 is a member of the small inducible cytokine subfamily A (cys-cys), member 14 (SCYA14). NEM4 is a secreted protein characterized by two adjacent cysteine residues. One isoform lacks internal 16 amino acids compared to isoform 2.

NEM 22 shares homology with guanylate kinase-interacting protein 1Maguin-1. It is a membrane associated protein.

NEM 23 is human signaling lymphocytic acitavation molecule (SLAM). It has a signal sequence at residues 1-20. The extracellular domain may reside at residues 21-237. There is a secreted isoform of the protein.

NEM33 is netrin 4. It induces neurite outgrowth and promotes vascular development. At higher concentration, neurite outgrowth is inhibited.

ECs represent only aminor fraction of the total cells within normal or tumor tissues, and only those EC transcripts expressed at the highest levels would be expected to be represented in libraries constructed from unfractionated tissues. The genes described in the current study should therefore provide a valuable resource for basic and clinical studies of human angiogenesis in the future. Genes which have been identified as tumor endothelial markers (TEMs) correspond to tags shown in SEQ ID NOS: 94-139, 173-176, 180-186. Genes which have been identified as normal endothelial markers (NEMs) correspond to tags shown in SEQ ID NOS: 140-172. Genes which have been identified as pan-endothelial markers (PEMs) i.e., expressed in both tumor and normal endothelial cells correspond to tags shown in SEQ ID NOS: 1-93. Genes which have been previously identified as being expressed predominantly in the endothehum correspond to PEM tags shown in SEQ ID NOS: 1-6, 8, 10-15. Markers in each class can be used interchangeably for some purposes.

Isolated and purified nucleic acids, according to the present invention are those which are not linked to those genes to which they are linked in the human genome. Moreover, they are not present in a mixture such as a library containing a multitude of distinct sequences from distinct genes. They may be, however, linked to other genes such as vector sequences or sequences of other genes to which they are not naturally adjacent. Tags disclosed herein, because of the way that they were made, represent sequences which are 3' of the 3' most restriction enzyme recognition site for the tagging enzyme used to generate the SAGE tags. In this case, the tags are 3' of the most 3' most NlaIII site in the cDNA molecules corresponding to mRNA. Nucleic acids corresponding to tags may be RNA, cDNA, or genomic DNA, for example. Such corresponding nucleic acids can be determined by comparison to sequence databases to determine sequence identities. Sequence comparisons can be done using any available technique, such as BLAST, available from the National Library of Medicine, National Center for Biotechnology Information. Tags can also be used as hybridization probes to libraries of genomic or cDNA to identify the genes from which they derive. Thus, using sequence comparisons or cloning, or combinations of these methods, one skilled in the art can obtain full-length nucleic acid sequences. Genes corresponding to tags will contain the sequence of the tag at the 3' end of the coding sequence or of the 3' untranslated region (UTR), 3' of the 3' most recognition site in the cDNA for the restriction endonuclease which was used to make the tags. The nucleic acids may represent either the sense or the anti-sense strand. Nucleic acids and proteins although disclosed herein with sequence particularity, may be derived from a single individual. Allelic variants which occur in the population of humans are including within the scope of such nucleic acids and proteins. Those of skill in the art are well able to identify allelic variants as being the same gene or protein Given a nucleic acid, one of ordinary skill in the art can readily determine an open reading frame present, and consequently the sequence of a polypeptide encoded by the open reading frame and, using techniques well known in the art, express such protein in a suitable host. Proteins comprising such polypeptides can be the naturally occurring proteins, fusion proteins comprising exogenous sequences from other genes from humans or other species, epitope tagged polypeptides, etc. Isolated and purified proteins are not in a cell, and are separated from the normal cellular constituents, such as nucleic acids, lipids, etc. Typically the protein is purified to such an extent that it comprises the predominant species of protein in the composition, such as greater than 50, 60 70, 80, 90, or even 95% of the proteins present.

Using the proteins according to the invention, one of ordinary skill in the art can readily generate antibodies which specifically bind to the proteins. Such antibodies can be monoclonal or polyclonal. They can be chimeric, humanized, or totally human. Any functional fragment or derivative of an antibody can be used including Fab, Fab', Fab2, Fab'2, and single chain variable regions. So long as the fragment or derivative retains specificity of binding for the endothelial marker protein it can be used. Antibodies can be tested for specificity of binding by comparing binding to appropriate antigen to binding to irrelevant antigen or antigen mixture under a given set of conditions. If the antibody binds to the appropriate antigen at least 2, 5, 7, and preferably 10 times more than to irrelevant antigen or antigen mixture then it is considered to be specific.

Techniques for making such partially to fully human antibodies are known in the art and any such techniques can be used. According to one particularly preferred embodiment, fully human antibody sequences are made in a transgenic mouse which has been engineered to express human heavy and light chain antibody genes. Multiple strains of such transgenic mice have been made which can produce different classes of antibodies. B cells from transgenic mice which are producing a desirable antibody can be fused to make hybridoma cell lines for continuous production of the desired antibody. See for example, Nina D. Russel, Jose R. F. Corvalan, Michael L. Gallo, C. Geoffrey Davis, Liise-Anne Pirofski. Production of Protective Human Antipneumococcal Antibodies by Transgenic Mice with Human Immunoglobulin Loci *Infection and Immunity* April 2000, p. 1820-1826; Michael L. Gallo, Vladimir E. Ivanov, Aya Jakobovits, and C. Geoffrey Davis. The human immunoglobulin loci introduced into mice: V (D) and J gene segment usage similar to that of adult humans *European Journal of Immunology* 30: 534-540, 2000; Larry L. Green. Antibody engineering via genetic engineering of the mouse: XenoMouse strains are a vehicle for the facile generation of therapeutic human monoclonal antibodies *Journal of Immunological Methods* 231 11-23, 1999; Yang X-D, Corvalan J R F, Wang P, Roy CM-N and Davis C G. Fully Human Anti-interleukin-8 Monoclonal Antibodies: Potential Therapeutics for the Treatment of Inflammatory Disease States. *Journal of Leukocyte Biology* Vol. 66, pp 401-410 (1999); Yang X-D, Jia X-C, Corvalan J R F, Wang P, C G Davis and Jakobovits A. Eradication of Established Tumors by a Fully Human Monoclonal Antibody to the Epidermal Growth Factor Receptor without Concomitant Chemotherapy. *Cancer Research* Vol. 59, Number 6, pp 1236-1243 (1999); Jakobovits A. Production and selection of antigen-specific fully human monoclonal antibodies from mice engineered with human Ig loci. *Advanced Drug Delivery Reviews* Vol. 31, pp: 33-42 (1998); Green L and Jakobovits A. Regulation of B cell development by variable gene complexity in mice reconstituted with human immunoglobulin yeast artificial chromosomes. *J. Exp. Med.* Vol. 188, Number 3, pp: 483-495 (1998); Jakobovits A. The long-awaited magic bullets: therapeutic human monoclonal antibodies from transgenic mice. *Exp. Opin. Invest. Drugs* Vol. 7(4), pp: 607-614 (1998); Tsuda H, Maynard-Currie K, Reid L, Yoshida T, Edamura K, Maeda N, Smithies O. Jakobovits A. Inactivation of Mouse HPRT locus by a 203-bp retrotransposon insertion and a 55-kb gene-targeted deletion: establishment of new HPRT-Deficient mouse embryonic stem cell lines. *Genomics* Vol. 42, pp: 413-421 (1997); Sherman-Gold, R. Monoclonal Antibodies: The Evolution from '80s Magic Bullets To Mature, Mainstream Applications as Clinical Therapeutics. *Genetic Engineering News* Vol. 17, Number 14 (August 1997); Mendez M, Green L, Corvalan J, Jia X-C, Maynard-Currie C, Yang X-d, Gallo M, Louie D, Lee D, Erickson K, Luna J, Roy C, Abderrahim H, Kirschenbaum F, Noguchi M, Smith D, Fukushima A, Hales J, Finer M, Davis C, Zsebo K, Jakobovits A. Functional transplant of megabase human immunoglobulin loci recapitulates human antibody response in mice. *Nature Genetics* Vol. 15, pp: 146-156 (1997); Jakobovits A. Mice engineered with human immunoglobulin YACs: A new technology for production of fully human antibodies for autoimmunity therapy. *Weir's Handbook of Experimental Immunology, The Integrated Immune System* Vol. IV, pp: 194.1-194.7 (1996); Jakobovits A. Production of fully human antibodies by transgenic mice. *Current Opinion in Biotechnology* Vol. 6, No. 5, pp: 561-566 (1995); Mendez M, Abderrahim H, Noguchi M, David N, Hardy M, Green L, Tsuda H, Yoast S, Maynard-Currie C, Garza D, Gemmill R, Jakobovits A, Klapholz S. Analysis of the structural integrity of YACs comprising human immunoglobulin genes in yeast and in embryonic stem cells. *Genomics* Vol. 26, pp: 294-307 (1995); Jakobovits A. YAC Vectors: Humanizing the mouse genome. *Current Biology* Vol. 4, No. 8, pp: 761-763 (1994); Arbones M, Ord D, Ley K, Ratech H, Maynard-Curry K, Otten G, Capon D, Tedder T. Lymphocyte homing and leukocyte rolling and migration are impaired in L-selectin-deficient mice. *Immunity* Vol. 1, No. 4, pp: 247-260 (1994); Green L, Hardy M, Maynard-Curry K, Tsuda H, Louie D, Mendez M, Abderrahim H, Noguchi M, Smith D, Zeng Y, et. al. Antigen-specific human monoclonal antibodies from mice engineered with human Ig heavy and light chain YACs. *Nature Genetics* Vol. 7, No. 1, pp: 13-21 (1994); Jakobovits A, Moore A, Green L, Vergara G, Maynard-Curry K, Austin H, Klapholz S. Germ-line transmission and expression of a human-derived yeast artificial chromosome. *Nature* Vol. 362, No. 6417, pp: 255-258 (1993) Jakobovits A, Vergara G, Kennedy J, Hales J, McGuinness R, Casentini-Borocz D, Brenner D, Otten G. Analysis of homozygous mutant chimeric mice: deletion of the immunoglobulin heavy-chain joining region blocks B-cell development and antibody production. *Proceedings of the National Academy of Sciences USA* Vol. 90, No. 6, pp: 2551-2555 (1993); Kucherlapati et al., U.S. Pat. No. 6,1075, 181.

Antibodies can also be made using phage display techniques. Such techniques can be used to isolate an initial antibody or to generate variants with altered specificity or avidity characteristics. Single chain Fv can also be used as is convenient. They can be made from vaccinated transgenic mice, if desired. Antibodies can be produced in cell culture, in phage, or in various animals, including but not limited to cows, rabbits, goats, mice, rats, hamsters, guinea pigs, sheep, dogs, cats, monkeys, chimpanzees, apes.

Antibodies can be labeled with a detectable moiety such as a radioactive atom, a chromophore, a fluorophore, or the like. Such labeled antibodies can be used for diagnostic techniques, either in vivo, or in an isolated test sample. Antibodies can also be conjugated, for example, to a pharmaceutical agent, such as chemotherapeutic drug or a toxin. They can be linked to a cytokine, to a ligand, to another antibody. Suitable agents for coupling to antibodies to achieve an anti-tumor effect include cytokines, such as interleukin 2 (IL-2) and Tumor Necrosis Factor (TNF); photosensitizers, for use in photodynamic therapy, including aluminum (III) phthalocyanine tetrasulfonate, hematoporphyrin, and phthalocyanine; radionuclides, such as iodine-131 ($^{131}$I), yttrium-90 ($^{90}$Y), bismuth-212 ($^{212}$Bi), bismuth-213 ($^{213}$Bi), technetium-99m ($^{99m}$Tc), rhenium-186 ($^{186}$Re), and rhenium-188 ($^{188}$Re); antibiotics, such as doxorubicin, adriamycin, daunorubicin, methotrexate, daunomycin, neocarzinostatin, and carboplatin; bacterial, plant, and other toxins, such as diphtheria toxin, pseudomonas exotoxin A, staphylococcal enterotoxin A, abrin-A toxin, ricin A (deglycosylated ricin A and native ricin A), TGF-alpha toxin, cytotoxin from chinese cobra (naja naja atra), and gelonin (a plant toxin); ribosome inactivating proteins from plants, bacteria and fungi, such as restrictocin (a ribosome inactivating protein produced by *Aspergillus restrictus*), saporin (a ribosome inactivating protein from *Saponaria officinalis*), and RNase; tyrosine kinase inhibitors; ly207702 (a difluorinated purine nucleoside); liposomes containing antitumor agents (e.g., antisense oligonucleotides, plasmids which encode for toxins, methotrexate, etc.); and other antibodies or antibody fragments, such as F(ab).

Those of skill in the art will readily understand and be able to make such antibody derivatives, as they are well known in the art. The antibodies may be cytotoxic on their own, or they may be used to deliver cytotoxic agents to particular locations in the body. The antibodies can be administered to individuals in need thereof as a form of passive immunization.

Characterization of extracellular regions for the cell surface and secreted proteins from the protein sequence is based on the prediction of signal sequence, transmembrane domains and functional domains. Antibodies are preferably specifically immunoreactive with membrane associated proteins, particularly to extracellular domains of such proteins or to secreted proteins. Such targets are readily accessible to antibodies, which typically do not have access to the interior of cells or nuclei. However, in some applications, antibodies directed to intracellular proteins may be useful as well. Moreover, for diagnostic purposes, an intracellular protein may be an equally good target since cell lysates may be used rather than a whole cell assay.

Computer programs can be used to identify extracellular domains of proteins whose sequences are known. Such programs include SMART software (Schultz et al., Proc. Natl. Acad. Sci. USA 95: 5857-5864, 1998) and Pfam software (Bateman et al., Nucleic acids Res. 28: 263-266, 2000) as well as PSORTII. Typically such programs identify transmembrane domains; the extracellular domains are identified as immediately adjacent to the transmembrane domains. Prediction of extracellular regions and the signal cleavage sites are only approximate. It may have a margin of error + or −5 residues. Signal sequence can be predicted using three different methods (Nielsen et al, *Protein Engineering* 10: 1-6, 1997, Jagla et. al, Bioinformatics 16: 245-250, 2000, Nakai, K and Horton, P. Trends in Biochem.

Sci. 24:34-35, 1999) for greater accuracy. Similarly transmembrane (TM) domains can be identified by multiple prediction methods. (Pasquier, et. al, Protein Eng. 12:381-385, 1999, Sonnhammer et al., In Proc. of Sixth Int. Conf. on Intelligent Systems for Molecular Biology, p. 175-182, Ed J. Glasgow, T. Littlejohn, F. Major, R. Lathrop, D. Sankoff, and C. Sensen Menlo Park, Calif.: AAAI Press, 1998, Klein, et. al, Biochim. Biophys. Acta, 815:468, 1985, Nakai and Kanehisa Genomics, 14: 897-911, 1992). In ambiguous cases, locations of functional domains in well characterized proteins are used as a guide to assign a cellular localization.

Putative functions or functional domains of novel proteins can be inferred from homologous regions in the database identified by BLAST searches (Altschul et. al. Nucleic Acid Res. 25: 3389-3402, 1997) and/or from a conserved domain database such as Pfam (Bateman et.al, Nucleic Acids Res. 27:260-262 1999) BLOCKS (Henikoff, et. al, Nucl. Acids Res. 28:228-230, 2000) and SMART (Ponting, et. al, Nucleic Acid Res. 27,229-232, 1999). Extracellular domains include regions adjacent to a transmembrane domain in a single transmembrane domain protein (out-in or type I class). For multiple transmembrane domains proteins, the extracellular domain also includes those regions between two adjacent transmembrane domains (in-out and out-in). For type II transmembrane domain proteins, for which the N-terminal region is cytoplasmic, regions following the transmembrane domain is generally extracellular. Secreted proteins on the other hand do not have a transmembrane domain and hence the whole protein is considered as extracellular.

Membrane associated proteins can be engineered to delete the transmembrane domains, thus leaving the extracellular portions which can bind to ligands. Such soluble forms of transmembrane receptor proteins can be used to compete with natural forms for binding to ligand. Thus such soluble forms act as inhibitors. and can be used therapeutically as anti-angiogenic agents, as diagnostic tools for the quantification of natural ligands, and in assays for the identification of small molecules which modulate or mimic the activity of a TEM:ligand complex.

Alternatively, the endothelial markers themselves can be used as vaccines to raise an immune response in the vaccinated animal or human. For such uses, a protein, or immunogenic fragment of such protein, corresponding to the intracellular, extracellular or secreted TEM of interest is administered to a subject. The immogenic agent may be provided as a purified preparation or in an appropriately expressing cell. The administration may be direct, by the delivery of the immunogenic agent to the subject, or indirect, through the delivery of a nucleic acid encoding the immunogenic agent under conditions resulting in the expression of the immunogenic agent of interest in the subject. The TEM of interest may be delivered in an expressing cell, such as a purified population of tumor endothelial cells or a populations of fused tumor endothelial and dendritic cells. Nucleic acids encoding the TEM of interest may be delivered in a viral or non-viral delivery vector or vehicle. Non-human sequences encoding the human TEM of interest or other mammalian homolog can be used to induce the desired immunologic response in a human subject. For several of the TEMs of the present invention, mouse, rat or other ortholog sequences are described herein or can be obtained from the literature or using techniques well within the skill of the art.

Endothelial cells can be identified using the markers which are disclosed herein as being endothelial cell specific. These include the human markers identified by SEQ ID NOS: 1-172, i.e., the normal, pan-endothelial, and the tumor endothelial markers. Homologous mouse markers include tumor endothelial markers of SEQ ID NO: 182-186 and 190-194. Antibodies specific for such markers can be used to identify such cells, by contacting the antibodies with a population of cells containing some endothelial cells. The presence of cross-reactive material with the antibodies identifies particular cells as endothelial. Similarly, lysates of cells can be tested for the presence of cross-reactive material. Any known format or technique for detecting cross-reactive material can be used including, immunoblots, radioimmunoassay, ELISA, immunoprecipitation, and immunohistochemistry. In addition, nucleic acid probes for these markers can also be used to identify endothelial cells. Any hybridization technique known in the art including Northern blotting, RT-PCR, microarray hybridization, and in situ hybridization can be used.

One can identify tumor endothelial cells for diagnostic purposes, testing cells suspected of containing one or more TEMs. One can test both tissues and bodily fluids of a subject. For example, one can test a patient's blood for evidence of intracellular and membrane associated TEMs, as well as for secreted TEMs. Intracellular and/or membrane associated TEMs may be present in bodily fluids as the result of high levels of expression of these factors and/or through lysis of cells expressing the TEMs.

Populations of various types of endothelial cells can also be made using the antibodies to endothelial markers of the invention. The antibodies can be used to purify cell populations according to any technique known in the art, including but not limited to fluorescence activated cell sorting. Such techniques permit the isolation of populations which are at least 50, 60, 70, 80, 90, 92, 94, 95, 96, 97, 98, and even 99% the type of endothelial cell desired, whether normal, tumor, or pan-endothelial. Antibodies can be used to both positively select and negatively select such populations. Preferably at least 1, 5, 10, 15, 20, or 25 of the appropriate markers are expressed by the endothelial cell population.

Populations of endothelial cells made as described herein, can be used for screening drugs to identify those suitable for inhibiting the growth of tumors by virtue of inhibiting the growth of the tumor vasculature.

Populations of endothelial cells made as described herein, can be used for screening candidate drugs to identify those suitable for modulating angiogenesis, such as for inhibiting the growth of tumors by virtue of inhibiting the growth of endothelial cells, such as inhibiting the growth of the tumor or other undesired vasculature, or alternatively, to promote the growth of endothelial cells and thus stimulate the growth of new or additional large vessel or microvasculature.

Inhibiting the growth of endothelial cells means either regression of vasculature which is already present, or the slowing or the absence of the development of new vascularization in a treated system as compared with a control system. By stimulating the growth of endothelial cells, one can influence development of new (neovascularization) or additional vasculature development (revascularization). A variety of model screen systems are available in which to test the angiogenic and/or anti-angiogenic properties of a given candidate drug. Typical tests involve assays measuring the endothelial cell response, such as proliferation, migration, differentiation and/or intracellular interaction of a given candidate drug. By such tests, one can study the signals and effects of the test stimuli. Some common screens involve measurement of the inhibition of heparanase, endothelial tube formation on Matrigel, scratch induced motility of endothelial cells, platelet-derived growth factor driven proliferation of vascular smooth muscle cells, and the rat aortic ring assay (which provides an advantage of capillary formation rather than just one cell type).

Drugs can be screened for the ability to mimic or modulate, inhibit or stimulate, growth of tumor endothelium cells and/or normal endothelial cells. Drugs can be screened for the ability to inhibit tumor endothelium growth but not normal endothelium growth or survival. Similarly, human cell populations, such as normal endothelium populations or tumor endothelial cell populations, can be contacted with test substances and the expression of tumor endothelial markers and/or normal endothelial markers determined. Test substances which decrease the expression of tumor endothelial markers (TEMs) are candidates for inhibiting angiogenesis and the growth of tumors. Conversely, markers which are only expressed in normal endothelium but not in tumor endothelium (NEMs) can be monitored. Test substances which increase the expression of such NEMs in tumor endothelium and other human cells can be identified as candidate antitumor or anti-angiogenic drugs In cases where the activity of a TEM or NEM is known, agents can be screened for their ability to decrease or increase the activity.

For those tumor endothelial markers identified as containing transmembrane regions, it is desirable to identify drug candidates capable of binding to the TEM receptors found at the cell surface. For some applications, the identification of drug candidates capable of blocking the TEM receptor from its native ligand will be desired. For some applications, the identification of a drug candidate capable of binding to the TEM receptor may be used as a means to deliver a therapeutic or diagnostic agent. For other applications, the identification of drug candidates capable of mimicking the activity of the native ligand will be desired. Thus, by manipulating the binding of a transmembrane TEM receptor:ligand complex, one may be able to promote or inhibit further development of endothelial cells and hence, vascularization.

For those tumor endothelial markers identified as being secreted proteins, it is desirable to identify drug candidates capable of binding to the secreted TEM protein. For some applications, the identification of drug candidates capable of interfering with the binding of the secreted TEM it is native receptor. For other applications, the identification of drug candidates capable of mimicing the activity of the native receptor will be desired. Thus, by manipulating the binding of the secreted TEM:receptor complex, one may be able to promote or inhibit further development of endothelial cells, and hence, vascularization.

Expression can be monitored according to any convenient method. Protein or mRNA can be monitored. Any technique known in the art for monitoring specific genes' expression can be used, including but not limited to ELISAs, SAGE, microarray hybridization, Western blots. Changes in expression of a single marker may be used as a criterion for significant effect as a potential pro-angiogenic, anti-angiogenic or anti-tumor agent. However, it also may be desirable to screen for test substances which are able to modulate the expression of at least 5, 10, 15, or 20 of the relevant markers, such as the tumor or normal endothelial markers. Inhibition of TEM protein activity can also be used as a drug screen. Human and mouse TEMS can be used for this purpose.

Test substances for screening can come from any source. They can be libraries of natural products, combinatorial chemical libraries, biological products made by recombinant libraries, etc. The source of the test substances is not critical to the invention. The present invention provides means for screening compounds and compositions which may previously have been overlooked in other screening schemes. Nucleic acids and the corresponding encoded proteins of the markers of the present invention can be used therapeutically in a variety of modes. NEMs, can be used to restrict, diminish, reduce, or inhibit proliferation of tumor or other abnormal or undesirable vasculature. TEMs can be used to stimulate the growth of vasculature, such as for wound healing or to circumvent a blocked vessel. The nucleic acids and encoded proteins can be administered by any means known in the art. Such methods include, using liposomes, nanospheres, viral vectors, non-viral vectors comprising polycations, etc. Suitable viral vectors include adenovirus, retroviruses, and sindbis virus. Administration modes can be any known in the art, including parenteral, intravenous, intramuscular, intraperitoneal, topical, intranasal, intrarectal, intrabronchial, etc.

Specific biological antagonists of TEMs can also be used to therapeutic benefit. For example, antibodies, T cells specific for a TEM, antisense to a TEM, and ribozymes specific for a TEM can be used to restrict, inhibit, reduce, and/or diminish tumor or other abnormal or undesirable vasculature growth. Such antagonists can be administered as is known in the art for these classes of antagonists generally. Anti-angiogenic drugs and agents can be used to inhibit tumor growth, as well as to treat diabetic retinopathy, rheumatoid arthritis, psoriasis, polycystic kidney disease (PKD), and other diseases requiring angiogenesis for their pathologies.

Mouse counterparts to human TEMS can be used in mouse cancer models or in cell lines or in vitro to evaluate potential anti-angiogenic or anti-tumor compounds or therapies. Their expression can be monitored as an indication of effect. Mouse TEMs are disclosed in SEQ ID NO: 182-186 and 190-194. Mouse TEMs can be used as antigens for raising antibodies which can be tested in mouse tumor models. Mouse TEMs with transmembrane domains are particularly preferred for this purpose. Mouse TEMs can also be used as vaccines to raise an immunological response in a human to the human ortholog.

The above disclosure generally describes the present invention. All references disclosed herein are expressly incorporated by reference. A more complete understanding can be obtained by reference to the following specific examples which are provided herein for purposes of illustration only, and are not intended to limit the scope of the invention.

EXAMPLE 1

Visualization of Vasculature of Colorectal Cancers

The endothelium of human colorectal cancer was chosen to address the issues of tumor angiogenesis, based on the high incidence, relatively slow growth, and resistance to anti-neoplastic agents of these cancers. While certain less common tumor types, such as glioblastomas, are highly vascularized and are regarded as good targets for anti-angiogenic therapy, the importance of angiogenesis for the growth of human colorectal cancers and other common solid tumor types is less well documented.

We began by staining vessels in colorectal cancers using von Willebrand Factor (vWF) as a marker. In each of 6 colorectal tumors, this examination revealed a high density of vessels throughout the tumor parenchyma (Examples in FIGS. 1A and B). Interestingly, these analyses also substantiated the importance of these vessels for tumor growth, as endothelium was often surrounded by a perivascular cuff of viable cells, with a ring of necrotic cells evident at the periphery (Example in FIG. 1A). Although these preliminary studies suggested that colon tumors are angiogenesis-dependent, reliable markers that could distinguish vessels in colon cancers from the vessels in normal colon are currently lacking. One way to determine if such markers exist is by analyzing gene expression profiles in endothelium derived from normal and neoplastic tissue.

EXAMPLE 2

Purification of Endothelial Cells

Global systematic analysis of gene expression in tumor and normal endothelium has been hampered by at least three experimental obstacles. First, endothelium is enmeshed in a complex tissue consisting of vessel wall components, stromal cells, and neoplastic cells, requiring highly selective means of purifying ECs for analysis. Second, techniques for defining global gene expression profiles were not available until recently. And third, only a small fraction of the cells within a tumor are endothelial, mandating the development of methods that are suitable for the analysis of global expression profiles from relatively few cells.

Figure 2:
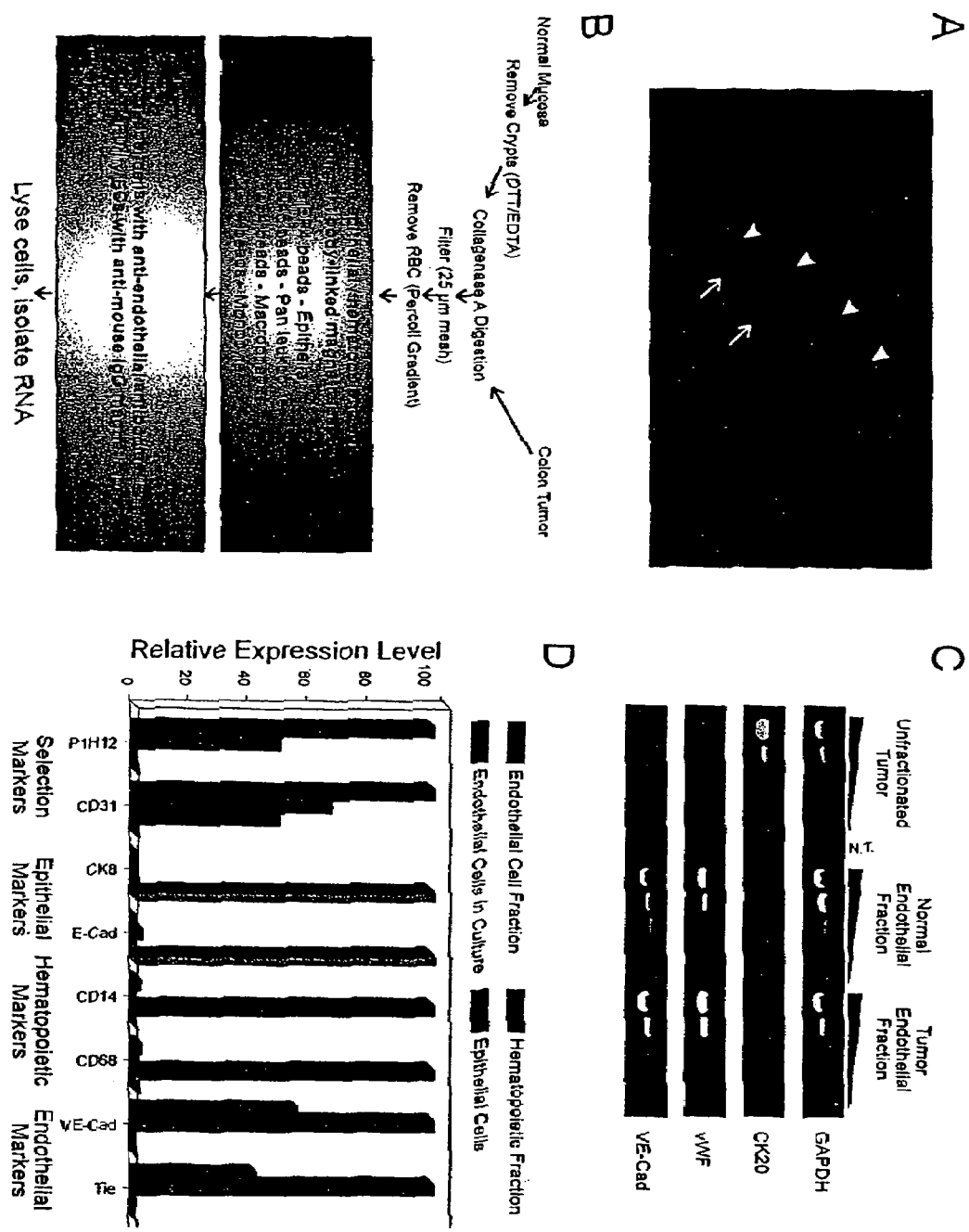
(FIG. 2.B) To isolate pure populations from collagenase dispersed tissues, the epithelial and hematopoietic cell fractions were sequentially removed by negative selection with magnetic beads. The remaining cells were stained with P1H12 and ECs were isolated by positive selection with magnetic beads.

To overcome the first obstacle, we initially attempted to purify ECs from dispersed human colorectal tissue using CD31, an endothelial marker commonly used for this purpose. This resulted in a substantial enrichment of ECs but also resulted in contamination of the preparations by hematopoietic cells, most likely due to expression of CD31 by macrophages. We therefore developed a new method for purifying ECs from human tissues using P1H12, a recently described marker for ECs. Unlike CD31, P1H12 was specifically expressed on the ECs of both colorectal tumors and normal colorectal mucosa. Moreover, immunofluorescence staining of normal and cancerous colon with a panel of known cell surface endothelial markers (e.g. VE-cadherin, CD31 and CD34) revealed that P1H12 was unique in that it stained all vessels including microvessels (see FIG. 2A and data not shown). In addition to selection with P1H 12, it was necessary to optimize the detachment of ECs from their neighbors without destroying their cell surface proteins as well as to employ positive and negative affinity purifications using a cocktail of antibodies (FIG. 2B). The ECs purified from normal colorectal mucosa and colorectal cancers were essentially free of epithelial and hematopoietic cells as judged by RT-PCR (FIG. 2C) and subsequent gene expression analysis (see below).

EXAMPLE 3

Comparison of Tumor and Normal Endothelial Cell Expression Patterns

To overcome the remaining obstacles, a modification of the Serial Analysis of Gene Expression (SAGE) technique was used. SAGE associates individual mRNA transcripts with 14 base pair tags derived from a specific position near their 3' termini. The abundance of each tag provides a quantitative measure of the transcript level present within the mRNA population studied. SAGE is not dependent on pre-existing databases of expressed genes, and therefore provides an unbiased view of gene expression profiles. This feature is particularly important in the analysis of cells that constitute only a small fraction of the tissue under study, as transcripts from these cells are unlikely to be well represented in extant EST databases. We adapted the SAGE protocol so that it could be used on small numbers of purified ECs obtained from the procedure outlined in FIG. 2B. A library of ~100,000 tags from the purified ECs of a colorectal cancer, and a similar library from the ECs of normal colonic mucosa from the same patient were generated. These ~193,000 tags corresponded to over 32,500 unique transcripts. Examination of the expression pattern of hematopoietic, epithelial and endothelial markers confirmed the purity of the preparations (FIG. 2D).

EXAMPLE 4

Markers of Normal and Tumor Endothelium

Figure 3:
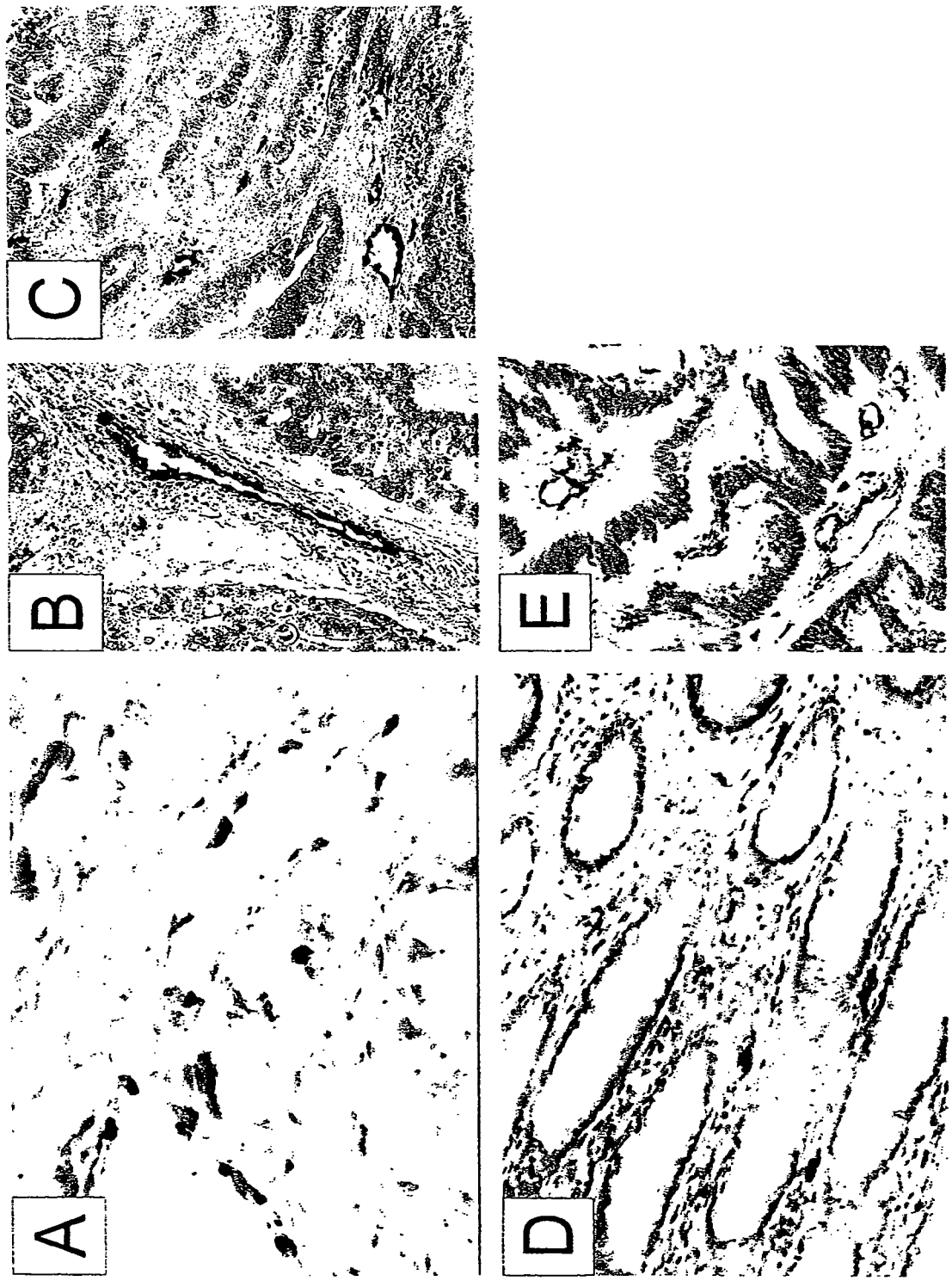
FIG. 3A-3E). Expression of Pan-Endothelial Markers (PEMs) is limited to ECs. The endothelial origin of PEMs identified by SAGE was confirmed using a highly sensitive in situ hybridization assay. Localization of novel PEMs to the ECs was demonstrated by examining two representative PEMs, PEM3 (FIG. 3A) and PEM6 (FIG. 3B) in lung cancer and colon cancer, respectively. Hevin expression was readily detected in the ECs of a colon tumor (FIG. 3C) despite its low level of expression in cultured ECs. Expression of VEGFR2 was readily detectable in the ECs of both normal (FIG. 3D) and malignant colon tissue (FIG. 3E).

We next sought to identify Pan Endothelial Markers (PEMs), that is, transcripts that were expressed at significantly higher levels in both normal and tumor associated endothelium compared to other tissues. To identify such PEMs, tags expressed at similar levels in both tumor and normal ECs were compared to ~1.8 million tags from a variety of cell lines derived from tumors of non-endothelial origin. This simple comparison identified 93 transcripts that were strikingly EC-specific, i.e. expressed at levels at least 20-fold higher in ECs in vivo compared to non-endothelial cells in culture. The 15 tags corresponding to characterized genes which were most highly and specifically expressed in endothelium are shown in Table 1A. Twelve of these 15 most abundant endothelial transcripts had been previously shown to be preferentially expressed in endothelium, while the other 3 genes had not been associated with endothelium in the past (Table 1A). These data sets also revealed many novel PEMs, which became increasingly prevalent as tag expression levels decreased (Table 1B). For many of the transcripts, their endothelial origin was confirmed by SAGE analysis of 401,000 transcripts derived from primary cultures of human umbilical vein endothelial cells (HUVEC) and human dermal microvascular endothelial cells (HM-VEC) (Table 1A and B). To further validate the expression of these PEMs in vivo, we developed a highly sensitive non-radioactive in situ hybridization method that allowed the detection of transcripts expressed at relatively low levels in frozen sections of human tissues. Two uncharacterized markers, PEM3 and PEM6, were chosen for this analysis. In each case, highly specific expression was clearly limited to vascular ECs in both normal and neoplastic tissues (FIGS. 3A and B and data not shown). These data also suggest that ECs maintained in culture do not completely recapitulate expression patterns observed in vivo. For example, Hevin and several other PEM's were expressed at high levels in both tumor and normal ECs in vivo, but few or no transcripts were detected in cultured HUVEC or HMVEC (Table 1). The source of the Hevin transcripts was confirmed to be endothelium by in situ hybridization in normal and malignant colorectal tissue (FIG. 3C).

Many of the markers reported in Table 1 were expressed at significantly higher levels than previously characterized genes commonly associated with ECs. For example, the top 25 markers were all expressed at greater than 200 copies per cell. In contrast, the receptors for VEGF (VEGFR-1 and VEGFR-2) were expressed at less than 20 copies per cell. Interestingly, VEGFR2 (KDR), which had previously been reported to be up-regulated in vessels during colon cancer progression, was found to be expressed in both normal and neoplastic colorectal tissue (FIGS. 3D and E). The lack of specificity of this gene was in accord with the SAGE data, which indicated that the VEGFR was expressed at 12 copies per cell in both normal and tumor endothelium.

EXAMPLE 5

Tumor Versus Normal Endothelium

We next attempted to identify transcripts that were differentially expressed in endothelium derived from normal or neoplastic tissues. This comparison revealed 33 tags that were preferentially expressed in normal-derived endothelium at levels at least 10-fold higher than in tumor-derived endothelium. Conversely, 46 tags were expressed at 10-fold or higher levels in tumor vessels. Because those transcripts expressed at higher levels in tumor endothelium are most likely to be useful in the future for diagnostic and therapeutic purposes, our subsequent studies focussed on this class. Of the top 25 tags most differentially expressed, 12 tags corresponded to 11 previously identified genes, one with an alternative polyadenylation site (see Table 2). Of these 10 genes, 6 have been recognized as markers associated with angiogenic vessels. The remaining 14 tags corresponded to uncharacterised genes, most of which have only been deposited as ESTs (Table 2).

To validate the expression patterns of these genes, we chose to focus on 9 Tumor Endothelial Markers (BSC-TEM 1-9; TEM 1, 2, 5, 9, 16, 17, 19, and 22) for which EST sequences but no other information was available (Table 2). These tags were chosen simply because they were among the most differentially expressed on the list and because we were able to obtain suitable probes. In many cases, this required obtaining near full-length sequences through multiple rounds of sequencing and cDNA walking (See accession numbers in Table 2). RT-PCR analysis was then used to evaluate the expression of the corresponding transcripts in purified ECs derived from normal and tumor tissues of two patients different from the one used to construct the SAGE libraries. As shown in FIG. 4A, the vWF gene, expected to be expressed in both normal and tumor endothelium on the basis of the SAGE data as well as previous studies, was expressed at similar levels in normal and tumor ECs from both patients, but was not expressed in purified tumor epithelial cells. As expected, PEM2 displayed a pattern similar to vWF. In contrast, all 9 TEMs chosen for this analysis were prominently expressed in tumor ECs, but were absent or barely detectable in normal ECs (Table 3 and examples in FIG. 4A). It is important to note that these RT-PCR assays were extremely sensitive indicators of expression, and the absence of detectable transcripts in the normal endothelium, combined with their presence in tumor endothelial RNAs even when diluted 100-fold, provides compelling confirmatory evidence for their differential expression. These results also show that these transcripts were not simply expressed differentially in the ECs of the original patient, but were characteristic of colorectal cancer endothelium in general.

It could be argued that the results noted above were compromised by the possibility that a small number of non-endothelial cells contaminated the cell populations used for SAGE and RT-PCR analyses, and that these non-endothelial cells were responsible for the striking differences in expression of the noted transcripts. To exclude this possibility, we performed in situ hybridization on normal and neoplastic colon tissue. In every case where transcripts could be detected (BSC-TEM 1, 3, 4, 5, 7, 8, and 9; TEM 1, 5, 9, 17, and 19), they were specifically localized to ECs (Table 3 and examples in FIGS. 4B and C). Although caution must be used when interpreting negative in situ hybridization results, none of the TEMs were expressed in vascular ECs associated with normal colorectal tissue even though vWF and Hevin were clearly expressed (Table 3).

EXAMPLE 6

Tumor Endothelium Markers are Expressed in Multiple Tumor Types

Figure 4:
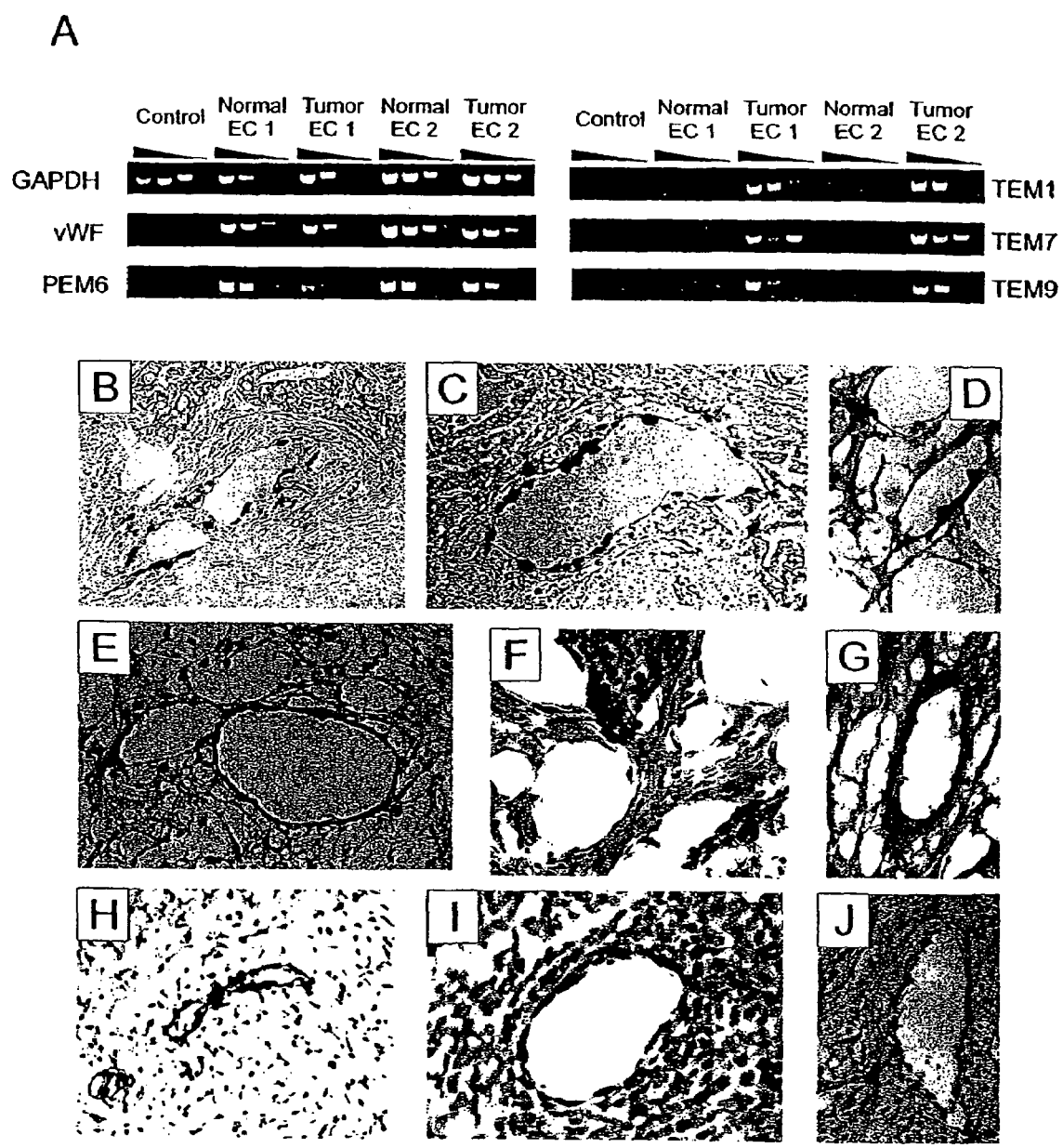
FIG. 4A-4J. Expression of Tumor Endothelial Markers (TEMs).

Were these transcripts specifically expressed in the endothelium within primary colorectal cancers, or were they characteristic of tumor endothelium in general? To address this question, we studied the expression of a representative TEM (BSC-TEM7; TEM 17) in a liver metastasis from a colorectal cancer, a sarcoma, and in primary cancers of the lung, pancreas, breast and brain. As shown in FIG. 4, the transcript was found to be expressed specifically in the endothelium of each of these cancers, whether metastatic (FIG. 4D) or primary (FIG. 4E-I). Analysis of the other six TEMs, (BSC-TEM 1, 3, 4, 5, 7, 8 and 9; TEM 1, 5, 9, 17, and 19) revealed a similar pattern in lung tumors, brain tumors, and metastatic lesions of the liver (see Table 3).

EXAMPLE 7

Tumor Endothelium Markers are Neo-angiogenic

Finally, we asked whether these transcripts were expressed in angiogenic states other than that associated with tumorigenesis. We thus performed in situ hybridizations on corpus luteum tissue as well as healing wounds. Although there were exceptions, we found that these transcripts were generally expressed both in the corpus luteum and in the granulation tissue of healing wounds (Table 3 and example in FIG. 4J). In all tissues studied, expression of the genes was either absent or exclusively confined to the EC compartment.

REFERENCES AND NOTES

The disclosure of each reference cited is expressly incorporated herein.

1. J. Folkman, in *Cancer Medicine* J. Holland, Bast Jr, R C, Morton D L, Frei III, E, Kufe, D W, Weichselbaum, R R, Ed. (Williams & Wilkins, Baltimore, 1997) pp. 181.
2. R. S. Kerbel, *Carcinogenesis* 21, 505 (2000).
3. P. Wesseling, D. J. Ruiter, P. C. Burger, *J Neurooncol* 32, 253 (1997).
4. Q. G. Dong, et al., *Arterioscler Thromb Vasc Biol* 17, 1599 (1997).
5. P. W. Hewett, J. C. Murray, *In Vitro Cell Dev Biol Anim* 32, 462 (1996).
6. M. A. Hull, P. W. Hewett, J. L. Brough, C. J. Hawkey, *Gastroenterology* 111, 1230 (1996).
7. G. Haraldsen, et al., *Gut* 37, 225 (1995).
8. The original EC isolation protocol was the same as that shown in FIG. 2B except that dispersed cells were stained with anti-CD31 antibodies instead of anti-P1H12, and magnetic beads against CD64 and CD14 were not included in the negative selection. After generating 120,000 SAGE tags from these two EC preparations, careful analysis of the SAGE data revealed that, in addition to endothelial-specific markers, several macrophage-specific markers were also present.
9. A. Solovey, et al., *N Engl J Med* 337, 1584 (1997).
10. V. E. Velculescu, L. Zhang, B. Vogelstein, K. W. Kinzler, *Science* 270, 484-487 (1995).
11. In order to reduce the minimum amount of starting material required from ~50 million cells to ~50,000 cells (i.e. ~1000-fold less) we and others (38) have introduced several modifications to the original SAGE protocol. A detailed version of our modified "MicroSAGE" protocol is available from the authors upon request.

12. 96,694 and 96,588 SAGE tags were analyzed from normal and tumor derived ECs, respectively, and represented 50,298 unique tags. A conservative estimate of 32,703 unique transcripts was derived by considering only those tags observed more than once in the current data set or in the 134,000 transcripts previously identified in human transcriptomes (39).

13. To identify endothelial specific transcripts, we normalized the number of tags analyzed in each group to 100,000, and limited our analysis to transcripts that were expressed at levels at least 20-fold higher in ECs than in non-endothelial cell lines in culture and present at fewer than 5 copies per 100,000 transcripts in non-endothelial cell lines and the hematopoietic fraction (~57,000 tags) (41). Non-endothelial cell lines consisted of 1.8×106 tags derived from a total of 14 different cancer cell lines including colon, breast, lung, and pancreatic cancers, as well as one non-transformed keratinocyte cell line, two kidney epithelial cell lines, and normal monocytes. A complete list of PEMs is available at www.sagenet.org\angio\table1.htm.

14. M. Tucci, et al., *J Endocrinol* 157, 13 (1998).
15. T. Oono, et al., *J Invest Dermatol* 100, 329 (1993).
16. K. Motamed, *Int J Biochem Cell Biol* 31, 1363 (1999).
17. N. Bardin, et al., *Tissue Antigens* 48, 531 (1996).
18. D. M. Bradham, A. Igarashi, R. L. Potter, G. R. Grotendorst, *J Cell Biol* 114, 1285 (1991).
19. K. Akaogi, et al., *Proc Natl Acad Sci USA* 93, 8384 (1996).
20. Y. Muragaki, et al., *Proc Natl Acad Sci USA* 92, 8763 (1995).
21. M. L. Iruela-Arispe, C. A. Diglio, E. H. Sage, *Arterioscler Thromb* 11, 805 (1991).
22. J. P. Girard, T. A. Springer, *Immunity* 2, 113 (1995).
23. E. A. Jaffe, et al., *J Immunol* 143, 3961 (1989).
24. J. P. Girard, et al., *Am J Pathol* 155, 2043 (1999).
25. H. Ohtani, N. Sasano, *J Electron Microsc* 36, 204 (1987).
26. For non-radioactive in situ hybridization, digoxigenin (DIG)-labelled sense and anti-sense riboprobes were generated through PCR by amplifying 500-600 bp products and incorporating a T7 promoter into the anti-sense primer. In vitro transcription was performed using DIG RNA labelling reagents and T7 RNA polymerase (Roche, Indianapolis, Ind.). Frozen tissue sections were fixed with 4% paraformaldehyde, permeabilized with pepsin, and incubated with 200 ng/ml of riboprobe overnight at 55° C. For signal amplification, a horseradish peroxidase (HRP) rabbit anti-DIG antibody (DAKO, Carpinteria, Calif.) was used to catalyse the deposition of Biotin-Tyramide (from GenPoint kit, DAKO). Further amplification Was achieved by adding HRP rabbit anti-biotin (DAKO), biotin-tyramide, and then alkaline-phosphatase (AP) rabbit anti-biotin (DAKO). Signal was detected using the AP substrate Fast Red TR/Napthol AS-MX (Sigma, St. Louis, Mo.), and cells were counterstained with hematoxylin unless otherwise indicated. A detailed protocol including the list of primers used to generate the probes can be obtained from the authors upon request.
27. Transcript copies per cell were calculated assuming an average cell contains 300,000 transcripts.
28. R. S. Warren, H. Yuan, M. R. Matli, N. A. Gillett, N. Ferrara, *J Clin Invest* 95, 1789 (1995).
29. Y. Takahashi, Y. Kitadai, C. D. Bucana, K. R. Cleary, L. M. Ellis, *Cancer Res* 55, 3964 (1995).
30. L. F. Brown, et al., *Cancer Res* 53, 4727 (1993).
31. Endothelial-specific transcripts were defined as those expressed at levels at least 5-fold higher in ECs in vivo than in non-endothelial cell lines in culture (13), and present at no more than 5 copies per 100,000 transcripts in non-endothelial cell lines and the hematopoietic cell fraction (41). Transcripts showing statistically different levels of expression (P<0.05) were then identified using Monte Carlo analysis as previously described (40). Transcripts preferentially expressed in normal endothelium were then defined as those expressed at levels at least 10-fold higher in normal endothelium than in tumor endothelium. Conversely, tumor endothelial transcripts were at least 10-fold higher in tumor versus normal endothelium. See www.sagenet.org\angio\table2.htm and www.sagenet.org\angio\table3.htm for a complete list of differentially expressed genes.
32. M. Iurlaro, et al., *Eur J Clin Invest* 29, 793 (1999).
33. W. S. Lee, et al., *Circ Res* 82, 845 (1998).
34. J. Niquet, A. Represa, *Brain Res Dev Brain Res* 95, 227 (1996).
35. L. Fouser, L. Iruela-Arispe, P. Bornstein, E. H. Sage, *J Biol Chem* 266, 18345 (1991).
36. M. L. Iruela-Arispe, P. Hasselaar, H. Sage, *Lab Invest* 64, 174 (1991).
37. H. F. Dvorak, *N Engl J Med* 315, 1650 (1986).
38. B. Virlon, et al., *Proc Natl Acad Sci USA* 96, 15286 (1999).
39. V. E. Velculescu, et al., *Nat Genet* 23, 387 (1999).
40. L. Zhang, et al., *Science* 276, 1268 (1997).
41. Human colon tissues were obtained within ½ hour after surgical removal from patients. Sheets of epithelial cells were peeled away from normal tissues with a glass slide following treatment with 5 mM DDT, then 10 mM EDTA, leaving the lamina propria intact. After a 2 h incubation in collagenase at 37° C., cells were filtered sequentially through 400 um, 100 um, 50 um and 25 um mesh, and spun through a 30% pre-formed Percoll gradient to pellet RBCs. Epithelial cells (Epithelial Fraction), which were found to non-specifically bind magnetic beads, were removed using Dynabeads coupled to BerEP4 (Dynal, Lake Success, N.Y.). Subsequently, macrophages and other leukocytes (Hematopoietic Fraction) were removed using a cocktail of beads coupled to anti-CD45, anti-CD 14 and anti-CD64 (Dynal). The remaining cells were stained with P1H12 antibody, purified with anti-mouse IgG-coupled magnetic beads, and lysed in mRNA lysis buffer. A detailed protocol can be obtained from the authors upon request.
42. H. Sheikh, H. Yarwood, A. Ashworth, C. M. Isacke, *J Cell Sci* 113, 1021-32 (2000).

| Sequence name | SEQ ID NO: | SEQ ID NO: | Sequence name |
|---|---|---|---|
| PEM 1 | 1 | 1 | PEM 1 |
| PEM 2 | 2 | 2 | PEM 2 |
| PEM 3 | 3 | 3 | PEM 3 |
| PEM 4 | 4 | 4 | PEM 4 |
| PEM 5 | 5 | 5 | PEM 5 |
| PEM 6 | 6 | 6 | PEM 6 |
| PEM 7 | 7 | 7 | PEM 7 |
| PEM 8 | 8 | 8 | PEM 8 |
| PEM 9 | 9 | 9 | PEM 9 |

-continued

| Sequence name | SEQ ID NO: | SEQ ID NO: | Sequence name |
|---|---|---|---|
| PEM 10 | 10 | 10 | PEM 10 |
| PEM 11 | 11 | 11 | PEM 11 |
| PEM 12 | 12 | 12 | PEM 12 |
| PEM 13 | 13 | 13 | PEM 13 |
| PEM 14 | 14 | 14 | PEM 14 |
| PEM 15 | 15 | 15 | PEM 15 |
| PEM 16 | 16 | 16 | PEM 16 |
| PEM 17 | 17 | 17 | PEM 17 |
| PEM 18 | 18 | 18 | PEM 18 |
| PEM 19 | 19 | 19 | PEM 19 |
| PEM 20 | 20 | 20 | PEM 20 |
| PEM 21 | 21 | 21 | PEM 21 |
| PEM 22 | 22 | 22 | PEM 22 |
| PEM 23 | 23 | 23 | PEM 23 |
| PEM 24 | 24 | 24 | PEM 24 |
| PEM 25 | 25 | 25 | PEM 25 |
| PEM 26 | 26 | 26 | PEM 26 |
| PEM 27 | 27 | 27 | PEM 27 |
| PEM 28 | 28 | 28 | PEM 28 |
| PEM 29 | 29 | 29 | PEM 29 |
| PEM 30 | 30 | 30 | PEM 30 |
| PEM 31 | 31 | 31 | PEM 31 |
| PEM 32 | 32 | 32 | PEM 32 |
| PEM 33 | 33 | 33 | PEM 33 |
| PEM 34 | 34 | 34 | PEM 34 |
| PEM 35 | 35 | 35 | PEM 35 |
| PEM 36 | 36 | 36 | PEM 36 |
| PEM 37 | 37 | 37 | PEM 37 |
| PEM 38 | 38 | 38 | PEM 38 |
| PEM 39 | 39 | 39 | PEM 39 |
| PEM 40 | 40 | 40 | PEM 40 |
| PEM 41 | 41 | 41 | PEM 41 |
| PEM 42 | 42 | 42 | PEM 42 |
| PEM 43 | 43 | 43 | PEM 43 |
| PEM 44 | 44 | 44 | PEM 44 |
| PEM 45 | 45 | 45 | PEM 45 |
| PEM 46 | 46 | 46 | PEM 46 |
| PEM 47 | 47 | 47 | PEM 47 |
| PEM 48 | 48 | 48 | PEM 48 |
| PEM 49 | 49 | 49 | PEM 49 |
| PEM 50 | 50 | 50 | PEM 50 |
| PEM 51 | 51 | 51 | PEM 51 |
| PEM 52 | 52 | 52 | PEM 52 |
| PEM 53 | 53 | 53 | PEM 53 |
| PEM 54 | 54 | 54 | PEM 54 |
| PEM 55 | 55 | 55 | PEM 55 |
| PEM 56 | 56 | 56 | PEM 56 |
| PEM 57 | 57 | 57 | PEM 57 |
| PEM 58 | 58 | 58 | PEM 58 |
| PEM 59 | 59 | 59 | PEM 59 |
| PEM 60 | 60 | 60 | PEM 60 |
| PEM 61 | 61 | 61 | PEM 61 |
| PEM 62 | 62 | 62 | PEM 62 |
| PEM 63 | 63 | 63 | PEM 63 |
| PEM 64 | 64 | 64 | PEM 64 |
| PEM 65 | 65 | 65 | PEM 65 |
| PEM 66 | 66 | 66 | PEM 66 |
| PEM 67 | 67 | 67 | PEM 67 |
| PEM 68 | 68 | 68 | PEM 68 |
| PEM 69 | 69 | 69 | PEM 69 |
| PEM 70 | 70 | 70 | PEM 70 |
| PEM 71 | 71 | 71 | PEM 71 |
| PEM 72 | 72 | 72 | PEM 72 |
| PEM 73 | 73 | 73 | PEM 73 |
| PEM 74 | 74 | 74 | PEM 74 |
| PEM 75 | 75 | 75 | PEM 75 |
| PEM 76 | 76 | 76 | PEM 76 |
| PEM 77 | 77 | 77 | PEM 77 |
| PEM 78 | 78 | 78 | PEM 78 |
| PEM 79 | 79 | 79 | PEM 79 |
| PEM 80 | 80 | 80 | PEM 80 |
| PEM 81 | 81 | 81 | PEM 81 |
| PEM 82 | 82 | 82 | PEM 82 |
| PEM 83 | 83 | 83 | PEM 83 |
| PEM 84 | 84 | 84 | PEM 84 |
| PEM 85 | 85 | 85 | PEM 85 |

-continued

| Sequence name | SEQ ID NO: | SEQ ID NO: | Sequence name |
|---|---|---|---|
| PEM 86 | 86 | 86 | PEM 86 |
| PEM 87 | 87 | 87 | PEM 87 |
| PEM 88 | 88 | 88 | PEM 88 |
| PEM 89 | 89 | 89 | PEM 89 |
| PEM 90 | 90 | 90 | PEM 90 |
| PEM 91 | 91 | 91 | PEM 91 |
| PEM 92 | 92 | 92 | PEM 92 |
| PEM 93 | 93 | 93 | PEM 93 |
| TEM 1 | 94 | 94 | TEM 1 |
| TEM 2 | 95 | 95 | TEM 2 |
| TEM 3 | 96 | 96 | TEM 3 |
| TEM 4 | 97 | 97 | TEM 4 |
| TEM 5 | 98 | 98 | TEM 5 |
| TEM 6 | 99 | 99 | TEM 6 |
| TEM 7 | 100 | 100 | TEM 7 |
| TEM 8 | 101 | 101 | TEM 8 |
| TEM 9 | 102 | 102 | TEM 9 |
| TEM 10 | 103 | 103 | TEM 10 |
| TEM 11 | 104 | 104 | TEM 11 |
| TEM 12 | 105 | 105 | TEM 12 |
| TEM 13 | 106 | 106 | TEM 13 |
| TEM 14 | 107 | 107 | TEM 14 |
| TEM 15 | 108 | 108 | TEM 15 |
| TEM 16 | 109 | 109 | TEM 16 |
| TEM 17 | 110 | 110 | TEM 17 |
| TEM 18 | 111 | 111 | TEM 18 |
| TEM 19 | 112 | 112 | TEM 19 |
| TEM 20 | 113 | 113 | TEM 20 |
| TEM 21 | 114 | 114 | TEM 21 |
| TEM 22 | 115 | 115 | TEM 22 |
| TEM 23 | 116 | 116 | TEM 23 |
| TEM 24 | 117 | 117 | TEM 24 |
| TEM 25 | 118 | 118 | TEM 25 |
| TEM 26 | 119 | 119 | TEM 26 |
| TEM 27 | 120 | 120 | TEM 27 |
| TEM 28 | 121 | 121 | TEM 28 |
| TEM 29 | 122 | 122 | TEM 29 |
| TEM 30 | 123 | 123 | TEM 30 |
| TEM 31 | 124 | 124 | TEM 31 |
| TEM 32 | 125 | 125 | TEM 32 |
| TEM 33 | 126 | 126 | TEM 33 |
| TEM 34 | 127 | 127 | TEM 34 |
| TEM 35 | 128 | 128 | TEM 35 |
| TEM 36 | 129 | 129 | TEM 36 |
| TEM 37 | 130 | 130 | TEM 37 |
| TEM 38 | 131 | 131 | TEM 38 |
| TEM 39 | 132 | 132 | TEM 39 |
| TEM 40 | 133 | 133 | TEM 40 |
| TEM 41 | 134 | 134 | TEM 41 |
| TEM 42 | 135 | 135 | TEM 42 |
| TEM 43 | 136 | 136 | TEM 43 |
| TEM 44 | 137 | 137 | TEM 44 |
| TEM 45 | 138 | 138 | TEM 45 |
| TEM 46 | 139 | 139 | TEM 46 |
| NEM 1 | 140 | 140 | NEM 1 |
| NEM 2 | 141 | 141 | NEM 2 |
| NEM 3 | 142 | 142 | NEM 3 |
| NEM 4 | 143 | 143 | NEM 4 |
| NEM 5 | 144 | 144 | NEM 5 |
| NEM 6 | 145 | 145 | NEM 6 |
| NEM 7 | 146 | 146 | NEM 7 |
| NEM 8 | 147 | 147 | NEM 8 |
| NEM 9 | 148 | 148 | NEM 9 |
| NEM 10 | 149 | 149 | NEM 10 |
| NEM 11 | 150 | 150 | NEM 11 |
| NEM 12 | 151 | 151 | NEM 12 |
| NEM 13 | 152 | 152 | NEM 13 |
| NEM 14 | 153 | 153 | NEM 14 |
| NEM 15 | 154 | 154 | NEM 15 |
| NEM 16 | 155 | 155 | NEM 16 |
| NEM 17 | 156 | 156 | NEM 17 |
| NEM 18 | 157 | 157 | NEM 18 |
| NEM 19 | 158 | 158 | NEM 19 |
| NEM 20 | 159 | 159 | NEM 20 |
| NEM 21 | 160 | 160 | NEM 21 |
| NEM 22 | 161 | 161 | NEM 22 |

-continued

| Sequence name | SEQ ID NO: | SEQ ID NO: | Sequence name |
|---|---|---|---|
| NEM 23 | 162 | 162 | NEM 23 |
| NEM 24 | 163 | 163 | NEM 24 |
| NEM 25 | 164 | 164 | NEM 25 |
| NEM 26 | 165 | 165 | NEM 26 |
| NEM 27 | 166 | 166 | NEM 27 |
| NEM 28 | 167 | 167 | NEM 28 |
| NEM 29 | 168 | 168 | NEM 29 |
| NEM 30 | 169 | 169 | NEM 30 |
| NEM 31 | 170 | 170 | NEM 31 |
| NEM 32 | 171 | 171 | NEM 32 |
| NEM 33 | 172 | 172 | NEM 33 |
| TEM 1 DNA | 173 | 173 | TEM 1 DNA |
| TEM 2 DNA | 174 | 174 | TEM 2 DNA |
| TEM 7 DNA | 175 | 175 | TEM 7 DNA |
| TEM 8 DNA | 176 | 176 | TEM 8 DNA |
| TEM 1 Protein | 177 | 177 | TEM 1 Protein |
| TEM 2 Protein | 178 | 178 | TEM 2 Protein |
| TEM 8 Protein | 179 | 179 | TEM 8 Protein |
| TEM 5 DNA | 180 | 180 | TEM 5 DNA |
| TEM 7B DNA | 181 | 181 | TEM 7B DNA |
| mTEM 1 DNA | 182 | 182 | mTEM 1 DNA |
| mTEM 5 DNA | 183 | 183 | mTEM 5 DNA |
| mTEM 7 DNA | 184 | 184 | mTEM 7 DNA |
| mTEM 7B DNA | 185 | 185 | mTEM 7B DNA |
| mTEM 8 DNA | 186 | 186 | mTEM 8 DNA |
| TEM 8 Protein | 187 | 187 | TEM 8 Protein |
| TEM 5 Protein | 188 | 188 | TEM 5 Protein |
| TEM 7B Protein | 189 | 189 | TEM 7B Protein |
| mTEM 1 Protein | 190 | 190 | mTEM 1 Protein |
| mTEM 5 Protein | 191 | 191 | mTEM 5 Protein |
| mTEM 7 Protein | 192 | 192 | mTEM 7 Protein |
| mTEM 7b Protein | 193 | 193 | mTEM 7b Protein |
| mTEM 8 Protein | 194 | 194 | mTEM 8 Protein |
| TEM 1 DNA | 195 | 195 | TEM 1 DNA |
| TEM 1 Protein | 196 | 196 | TEM 1 Protein |
| TEM 2 DNA | 197 | 197 | TEM 2 DNA |
| TEM 2 Protein | 198 | 198 | TEM 2 Protein |
| TEM 3 DNA | 199 | 199 | TEM 3 DNA |
| TEM 3 Protein | 200 | 200 | TEM 3 Protein |
| TEM 4 DNA | 201 | 201 | TEM 4 DNA |
| TEM 4 Protein | 202 | 202 | TEM 4 Protein |
| TEM 5 DNA | 203 | 203 | TEM 5 DNA |
| TEM 5 Protein | 204 | 204 | TEM 5 Protein |
| TEM 6 DNA | 205 | 205 | TEM 6 DNA |
| TEM 6 Protein | 206 | 206 | TEM 6 Protein |
| TEM 7 DNA | 207 | 207 | TEM 7 DNA |
| TEM 7 Protein | 208 | 208 | TEM 7 Protein |
| TEM 8 DNA | 209 | 209 | TEM 8 DNA |
| TEM 8 Protein | 210 | 210 | TEM 8 Protein |
| TEM 9 DNA | 211 | 211 | TEM 9 DNA |
| TEM 9 Protein | 212 | 212 | TEM 9 Protein |
| TEM 10 DNA | 213 | 213 | TEM 10 DNA |
| TEM 10 Protein | 214 | 214 | TEM 10 Protein |
| TEM 11 DNA | 215 | 215 | TEM 11 DNA |
| TEM 11 Protein | 216 | 216 | TEM 11 Protein |
| TEM 12 DNA | 217 | 217 | TEM 12 DNA |
| TEM 12 Protein | 218 | 218 | TEM 12 Protein |
| TEM 13 DNA | 219 | 219 | TEM 13 DNA |
| TEM 13 Protein | 220 | 220 | TEM 13 Protein |
| TEM 14a DNA | 221 | 221 | TEM 14a DNA |
| TEM 14b DNA | 222 | 222 | TEM 14b DNA |
| TEM 14a Protein | 223 | 223 | TEM 14a Protein |
| TEM 14b Protein | 224 | 224 | TEM 14b Protein |
| TEM 15 DNA | 225 | 225 | TEM 15 DNA |
| TEM 15 Protein | 226 | 226 | TEM 15 Protein |
| TEM 16 DNA | 227 | 227 | TEM 16 DNA |
| TEM 16 Protein | 228 | 228 | TEM 16 Protein |
| TEM 17 DNA | 229 | 229 | TEM 17 DNA |
| TEM 17 Protein | 230 | 230 | TEM 17 Protein |
| TEM 19 DNA | 231 | 231 | TEM 19 DNA |
| TEM 19 Protein | 232 | 232 | TEM 19 Protein |
| TEM 20 DNA | 233 | 233 | TEM 20 DNA |
| TEM 20 Protein | 234 | 234 | TEM 20 Protein |
| TEM 21 DNA | 235 | 235 | TEM 21 DNA |
| TEM 21 Protein | 236 | 236 | TEM 21 Protein |
| TEM 22 DNA | 237 | 237 | TEM 22 DNA |

-continued

| Sequence name | SEQ ID NO: | SEQ ID NO: | Sequence name |
|---|---|---|---|
| TEM 22 Protein | 238 | 238 | TEM 22 Protein |
| TEM 24 DNA | 239 | 239 | TEM 24 DNA |
| TEM 24 Protein | 240 | 240 | TEM 24 Protein |
| TEM 25 DNA | 241 | 241 | TEM 25 DNA |
| TEM 25 Protein | 242 | 242 | TEM 25 Protein |
| TEM 27 DNA | 243 | 243 | TEM 27 DNA |
| TEM 27 Protein | 244 | 244 | TEM 27 Protein |
| TEM 28 DNA | 245 | 245 | TEM 28 DNA |
| TEM 28 Protein | 246 | 246 | TEM 28 Protein |
| TEM 29 DNA | 247 | 247 | TEM 29 DNA |
| TEM 29 Protein | 248 | 248 | TEM 29 Protein |
| TEM 30 DNA | 249 | 249 | TEM 30 DNA |
| TEM 30 Protein | 250 | 250 | TEM 30 Protein |
| TEM 31 DNA | 251 | 251 | TEM 31 DNA |
| TEM 31 Protein | 252 | 252 | TEM 31 Protein |
| TEM 33 DNA | 253 | 253 | TEM 33 DNA |
| TEM 33 Protein | 254 | 254 | TEM 33 Protein |
| TEM 35 DNA | 255 | 255 | TEM 35 DNA |
| TEM 35 Protein | 358 | 256 | TEM 36 DNA |
| TEM 36 DNA | 256 | 257 | TEM 36 Protein |
| TEM 36 Protein | 257 | 258 | TEM 37 DNA |
| TEM 37 DNA | 258 | 259 | TEM 37 Protein |
| TEM 37 Protein | 259 | 260 | TEM 38 DNA |
| TEM 38 DNA | 260 | 261 | TEM 38 Protein |
| TEM 38 Protein | 261 | 262 | TEM 39 DNA |
| TEM 39 DNA | 262 | 263 | TEM 39 Protein |
| TEM 39 Protein | 263 | 264 | TEM 40 DNA |
| TEM 40 DNA | 264 | 265 | TEM 40 Protein |
| TEM 40 Protein | 265 | 266 | TEM 41 DNA |
| TEM 41 DNA | 266 | 267 | TEM 41 Protein |
| TEM 41 Protein | 267 | 268 | TEM 42 DNA |
| TEM 42 DNA | 268 | 269 | TEM 42 Protein |
| TEM 42 Protein | 269 | 270 | TEM 44 DNA |
| TEM 44 DNA | 270 | 271 | TEM 44 Protein |
| TEM 44 Protein | 271 | 272 | TEM 45 DNA |
| TEM 45 DNA | 272 | 273 | TEM 45 Protein |
| TEM 45 Protein | 273 | 274 | TEM 46 DNA |
| TEM 46 DNA | 274 | 275 | TEM 46 Protein |
| TEM 46 Protein | 275 | 276 | NEM 4 DNA |
| NEM 4 DNA | 276 | 277 | NEM 4 Protein |
| NEM 4 Protein | 277 | 278 | NEM 14 DNA |
| NEM 14 DNA | 278 | 279 | NEM 14 Protein |
| NEM 14 Protein | 279 | 280 | NEM 17 DNA |
| NEM 17 DNA | 280 | 281 | NEM 17 Protein |
| NEM 17 Protein | 281 | 282 | NEM 22 DNA |
| NEM 22 DNA | 282 | 283 | NEM 22 Protein |
| NEM 22 Protein | 283 | 284 | NEM 23 DNA |
| NEM 23 DNA | 284 | 285 | NEM 23 Protein |
| NEM 23 Protein | 285 | 286 | NEM 23 Secreted |
| NEM 23 Secreted | 286 | 287 | NEM 23 Short |
| NEM 23 Short | 287 | 288 | NEM 33 DNA |
| NEM 33 DNA | 288 | 289 | NEM 33 Protein |
| NEM 33 Protein | 289 | 290 | mTEM 1 DNA |
| mTEM 1 DNA | 290 | 291 | mTEM 1 Protein |
| mTEM 1 Protein | 291 | 292 | mTEM 2 DNA |
| mTEM 2 DNA | 292 | 293 | mTEM 2 Protein |
| mTEM 2 Protein | 293 | 294 | mTEM 9 DNA |
| mTEM 3 DNA | 298 | 295 | mTEM 9 Protein |
| mTEM 3 Protein | 299 | 296 | mTEM 17 DNA |
| mTEM 9 DNA | 294 | 297 | mTEM 17 Protein |
| mTEM 9 Protein | 295 | 298 | mTEM 3 DNA |
| mTEM 13 DNA | 302 | 299 | mTEM 3 Protein |
| mTEM 13 DNA | 303 | 300 | mTEM 19 DNA |
| mTEM 17 DNA | 296 | 301 | mTEM 19 Protein |
| mTEM 17 Protein | 297 | 302 | mTEM 13 DNA |
| mTEM 19 DNA | 300 | 303 | mTEM 13 Protein |
| mTEM 19 Protein | 301 | 304 | mTEM 22 DNA |
| mTEM 22 DNA | 304 | 305 | mTEM 22 Protein |
| mTEM 22 Protein | 305 | 306 | mTEM 30 DNA |
| mTEM 30 DNA | 306 | 307 | mTEM 30 Protein |
| mTEM 30 Protein | 307 | 308 | TEM 2 tag |
| TEM 2 tag | 308 | 309 | TEM 1 long tag |
| TEM 1 long tag | 309 | 310 | TEM 3 long tag |
| TEM 3 long tag | 310 | 311 | TEM 4 long tag |
| TEM 4 long tag | 311 | 312 | TEM 5 long tag |
| TEM 5 long tag | 312 | 313 | TEM 5 long tag |

-continued

| Sequence name | SEQ ID NO: | SEQ ID NO: | Sequence name |
|---|---|---|---|
| TEM 5 long tag | 313 | 314 | TEM 6 long tag |
| TEM 6 long tag | 314 | 315 | TEM 7 long tag |
| TEM 7 long tag | 315 | 316 | TEM 8 long tag |
| TEM 8 long tag | 316 | 317 | TEM 9 long tag |
| TEM 9 long tag | 317 | 318 | TEM 10 long tag |
| TEM 10 long tag | 318 | 319 | TEM 10 long tag |
| TEM 10 long tag | 319 | 320 | TEM 10 long tag |
| TEM 10 long tag | 320 | 321 | TEM 11 long tag |
| TEM 11 long tag | 321 | 322 | TEM 12 long tag |
| TEM 12 long tag | 322 | 323 | TEM 13 long tag |
| TEM 13 long tag | 323 | 324 | TEM 13 long tag |
| TEM 13 long tag | 324 | 325 | TEM 14 long tag |
| TEM 14 long tag | 325 | 326 | TEM 15 long tag |
| TEM 15 long tag | 326 | 327 | TEM 15 long tag |
| TEM 15 long tag | 327 | 328 | TEM 16 long tag |
| TEM 16 long tag | 328 | 329 | TEM 17 long tag |
| TEM 17 long tag | 329 | 330 | TEM 19 long tag |
| TEM 19 long tag | 330 | 331 | TEM 21 long tag |
| TEM 21 long tag | 331 | 332 | TEM 21 long tag |
| TEM 21 long tag | 332 | 333 | TEM 22 long tag |
| TEM 22 long tag | 333 | 334 | TEM 22 long tag |
| TEM 22 long tag | 334 | 335 | TEM 23 long tag |
| TEM 23 long tag | 335 | 336 | TEM 24 long tag |

-continued

| Sequence name | SEQ ID NO: | SEQ ID NO: | Sequence name |
|---|---|---|---|
| TEM 24 long tag | 336 | 337 | TEM 25 long tag |
| TEM 25 long tag | 337 | 338 | TEM 25 long tag |
| TEM 25 long tag | 338 | 339 | TEM 28 long tag |
| TEM 28 long tag | 339 | 340 | TEM 30 long tag |
| TEM 30 long tag | 340 | 341 | TEM 31 long tag |
| TEM 31 long tag | 341 | 342 | TEM 32 long tag |
| TEM 32 long tag | 342 | 343 | TEM 33 long tag |
| TEM 33 long tag | 343 | 344 | TEM 33 long tag |
| TEM 33 long tag | 344 | 345 | TEM 35 long tag |
| TEM 35 long tag | 345 | 346 | TEM 36 long tag |
| TEM 36 long tag | 346 | 347 | TEM 37 long tag |
| TEM 37 long tag | 347 | 348 | TEM 38 long tag |
| TEM 38 long tag | 348 | 349 | TEM 38 long tag |
| TEM 38 long tag | 349 | 350 | TEM 39 long tag |
| TEM 39 long tag | 350 | 351 | TEM 40 long tag |
| TEM 40 long tag | 351 | 352 | TEM 41 long tag |
| TEM 41 long tag | 352 | 353 | TEM 42 long tag |
| TEM 42 long tag | 353 | 354 | TEM 43 long tag |
| TEM 43 long tag | 354 | 355 | TEM 44 long tag |
| TEM 44 long tag | 355 | 356 | TEM 45 long tag |
| TEM 45 long tag | 356 | 357 | TEM 46 long tag |
| TEM 46 long tag | 357 | 358 | TEM 35 Protein |

SEQUENCE LISTING (358 sequences)

SEQ ID NO: 1 - DNA, 11 bp, Homo sapiens
catatcattaa

SEQ ID NO: 2 - DNA, 11 bp, Homo sapiens
tgcacttcaag

SEQ ID NO: 3 - DNA, 11 bp, Homo sapiens
tttgcaccttt

SEQ ID NO: 4 - DNA, 10 bp, Homo sapiens
cccttgtccg

SEQ ID NO: 5 - DNA, 11 bp, Homo sapiens
ttgctgacttt

SEQ ID NO: 6 - DNA, 11 bp, Homo sapiens
accattggatt

SEQ ID NO: 7 - DNA, 11 bp, Homo sapiens
acacttctttc

SEQ ID NO: 8 - DNA, 11 bp, Homo sapiens
ttctgctcttg

SEQ ID NO: 9 - DNA, 11 bp, Homo sapiens
tccctggcaga

SEQ ID NO: 10 - DNA, 11 bp, Homo sapiens
taatcctcaag

SEQ ID NO: 11 - DNA, 11 bp, Homo sapiens
atgtcttttct

SEQ ID NO: 12 - DNA, 11 bp, Homo sapiens
gggattaaagc

SEQ ID NO: 13 - DNA, 11 bp, Homo sapiens
ttagtgtcgta

SEQ ID NO: 14 - DNA, 11 bp, Homo sapiens
ttctcccaaat

SEQ ID NO: 15 - DNA, 11 bp, Homo sapiens
gtgctaagcgg

SEQ ID NO: 16 - DNA, 11 bp, Homo sapiens
gtttatggata

SEQ ID NO: 17 - DNA, 11 bp, Homo sapiens
ccctttcacac

SEQ ID NO: 18 - DNA, 11 bp, Homo sapiens
tgttctggaga

SEQ ID NO: 19 - DNA, 11 bp, Homo sapiens
aagatcaagat

SEQ ID NO: 20 - DNA, 11 bp, Homo sapiens
tctctgagcat

SEQ ID NO: 21 - DNA, 11 bp, Homo sapiens
caggtttcata

SEQ ID NO: 22 - DNA, 11 bp, Homo sapiens
gcacaagttct

SEQ ID NO: 23 - DNA, 11 bp, Homo sapiens
agcttgtggcc

SEQ ID NO: 24 - DNA, 11 bp, Homo sapiens
cttctggataa

SEQ ID NO: 25 - DNA, 11 bp, Homo sapiens
caacaataata

SEQ ID NO: 26 - DNA, 11 bp, Homo sapiens
accggcgcccg

SEQ ID NO: 27 - DNA, 11 bp, Homo sapiens
ggaagctaagt

SEQ ID NO: 28 - DNA, 11 bp, Homo sapiens
gcaatttaacc

SEQ ID NO: 29 - DNA, 11 bp, Homo sapiens
gataactacat

SEQ ID NO: 30 - DNA, 11 bp, Homo sapiens
tatgagggtaa

SEQ ID NO: 31 - DNA, 11 bp, Homo sapiens
ccacgggattc

SEQ ID NO: 32 - DNA, 11 bp, Homo sapiens
tttacaaagag

SEQ ID NO: 33 - DNA, 11 bp, Homo sapiens
cccagtaagat

SEQ ID NO: 34 - DNA, 11 bp, Homo sapiens
acaaagcattt

SEQ ID NO: 35 - DNA, 11 bp, Homo sapiens
gcctgtccctc

SEQ ID NO: 36 - DNA, 11 bp, Homo sapiens
tactttataag

SEQ ID NO: 37 - DNA, 11 bp, Homo sapiens
tgtttaataca

SEQ ID NO: 38 - DNA, 11 bp, Homo sapiens
gtccctgcctt

SEQ ID NO: 39 - DNA, 11 bp, Homo sapiens
gagccatcata

SEQ ID NO: 40 - DNA, 11 bp, Homo sapiens
ggccctacagt

SEQ ID NO: 41 - DNA, 11 bp, Homo sapiens
gctaacccctg

SEQ ID NO: 42 - DNA, 11 bp, Homo sapiens
atcacacagct

SEQ ID NO: 43 - DNA, 11 bp, Homo sapiens
acaagtactgt

SEQ ID NO: 44 - DNA, 11 bp, Homo sapiens
tcaccgtggac

SEQ ID NO: 45 - DNA, 11 bp, Homo sapiens
acattccaagt

SEQ ID NO: 46 - DNA, 11 bp, Homo sapiens
gagcctggata

SEQ ID NO: 47 - DNA, 11 bp, Homo sapiens
ggcactcctgt

SEQ ID NO: 48 - DNA, 11 bp, Homo sapiens
tcacagccccc

SEQ ID NO: 49 - DNA, 11 bp, Homo sapiens
tgccaggtgca

SEQ ID NO: 50 - DNA, 11 bp, Homo sapiens
tgggaaacctg

SEQ ID NO: 51 - DNA, 11 bp, Homo sapiens
tttcatccact

SEQ ID NO: 52 - DNA, 11 bp, Homo sapiens
aacaggggcca

SEQ ID NO: 53 - DNA, 11 bp, Homo sapiens
actgaaagaag

SEQ ID NO: 54 - DNA, 11 bp, Homo sapiens
accgttctgta

SEQ ID NO: 55 - DNA, 11 bp, Homo sapiens
atactataatt

SEQ ID NO: 56 - DNA, 11 bp, Homo sapiens
tttgtatagaa

SEQ ID NO: 57 - DNA, 11 bp, Homo sapiens
gtaatgacaga

SEQ ID NO: 58 - DNA, 11 bp, Homo sapiens
aataggggaaa

SEQ ID NO: 59 - DNA, 11 bp, Homo sapiens
gtgctacttct

SEQ ID NO: 60 - DNA, 11 bp, Homo sapiens
ccggcccctcc

SEQ ID NO: 61 - DNA, 11 bp, Homo sapiens
ttgaatttgtt

SEQ ID NO: 62 - DNA, 11 bp, Homo sapiens
cgagagtgtga

SEQ ID NO: 63 - DNA, 11 bp, Homo sapiens
ccctgttcagc

SEQ ID NO: 64 - DNA, 11 bp, Homo sapiens
cagatggaggc

SEQ ID NO: 65 - DNA, 11 bp, Homo sapiens
aggctcctggc

SEQ ID NO: 66 - DNA, 11 bp, Homo sapiens
tctgcttctag

SEQ ID NO: 67 - DNA, 11 bp, Homo sapiens
ggcttaggatg

SEQ ID NO: 68 - DNA, 11 bp, Homo sapiens
ggttgttgcgg

SEQ ID NO: 69 - DNA, 11 bp, Homo sapiens
acaagtaccca

SEQ ID NO: 70 - DNA, 11 bp, Homo sapiens
cttctcttgag

SEQ ID NO: 71 - DNA, 11 bp, Homo sapiens
gctaataatgt

SEQ ID NO: 72 - DNA, 11 bp, Homo sapiens
tgtgctttttt

SEQ ID NO: 73 - DNA, 11 bp, Homo sapiens
catcacggatc

SEQ ID NO: 74 - DNA, 11 bp, Homo sapiens
gcagcagcagc

SEQ ID NO: 75 - DNA, 11 bp, Homo sapiens
tgactgtatta

SEQ ID NO: 76 - DNA, 11 bp, Homo sapiens
gaatgctcttg

SEQ ID NO: 77 - DNA, 11 bp, Homo sapiens
gtagttctgga

SEQ ID NO: 78 - DNA, 11 bp, Homo sapiens
tcccctctctc

SEQ ID NO: 79 - DNA, 11 bp, Homo sapiens
gggcagtggct

SEQ ID NO: 80 - DNA, 11 bp, Homo sapiens
aaatatgtgtt

SEQ ID NO: 81 - DNA, 11 bp, Homo sapiens
gtcattttcta

SEQ ID NO: 82 - DNA, 11 bp, Homo sapiens
ctctccaaacc

SEQ ID NO: 83 - DNA, 11 bp, Homo sapiens
ttaatgtgtaa

SEQ ID NO: 84 - DNA, 11 bp, Homo sapiens
tcaagcaatca

SEQ ID NO: 85 - DNA, 11 bp, Homo sapiens
gaagacacttg

SEQ ID NO: 86 - DNA, 11 bp, Homo sapiens
gggtagggtga

SEQ ID NO: 87 - DNA, 11 bp, Homo sapiens
tggaacagtga

SEQ ID NO: 88 - DNA, 11 bp, Homo sapiens
gagtggctacc

SEQ ID NO: 89 - DNA, 11 bp, Homo sapiens
gtcagggtccc

SEQ ID NO: 90 - DNA, 11 bp, Homo sapiens
gtcagtcactt

SEQ ID NO: 91 - DNA, 11 bp, Homo sapiens
agcagagacaa

SEQ ID NO: 92 - DNA, 11 bp, Homo sapiens
agcgatggaga

SEQ ID NO: 93 - DNA, 11 bp, Homo sapiens
cgtggggtgta

SEQ ID NO: 94 - DNA, 11 bp, Homo sapiens
ggggctgccca

SEQ ID NO: 95 - DNA, 11 bp, Homo sapiens
gatctccgtgt

SEQ ID NO: 96 - DNA, 11 bp, Homo sapiens
catttttatct

SEQ ID NO: 97 - DNA, 11 bp, Homo sapiens
ctttctttgag

SEQ ID NO: 98 - DNA, 11 bp, Homo sapiens
tattaactctc

SEQ ID NO: 99 - DNA, 11 bp, Homo sapiens
caggagacccc

SEQ ID NO: 100 - DNA, 11 bp, Homo sapiens
ggaaatgtcaa

SEQ ID NO: 101 - DNA, 11 bp, Homo sapiens
cctggttcagt

SEQ ID NO: 102 - DNA, 11 bp, Homo sapiens
tttttaagaac

SEQ ID NO: 103 - DNA, 11 bp, Homo sapiens
tttggttttcc

SEQ ID NO: 104 - DNA, 11 bp, Homo sapiens
attttgtatga

SEQ ID NO: 105 - DNA, 11 bp, Homo sapiens
actttagatgg

SEQ ID NO: 106 - DNA, 11 bp, Homo sapiens
gagtgagaccc

SEQ ID NO: 107 - DNA, 11 bp, Homo sapiens
gtacacacacc

SEQ ID NO: 108 - DNA, 11 bp, Homo sapiens
ccacaggggat

SEQ ID NO: 109 - DNA, 11 bp, Homo sapiens
ttaaaagtcac

SEQ ID NO: 110 - DNA, 11 bp, Homo sapiens
acagactgtta

SEQ ID NO: 111 - DNA, 11 bp, Homo sapiens
ccactgcaacc

SEQ ID NO: 112 - DNA, 11 bp, Homo sapiens
ctataggagac

SEQ ID NO: 113 - DNA, 11 bp, Homo sapiens
gttccacagaa

SEQ ID NO: 114 - DNA, 11 bp, Homo sapiens
taccacctccc

SEQ ID NO: 115 - DNA, 11 bp, Homo sapiens
gccctttctct

SEQ ID NO: 116 - DNA, 11 bp, Homo sapiens
ttaaatagcac

SEQ ID NO: 117 - DNA, 11 bp, Homo sapiens
agacatactga

SEQ ID NO: 118 - DNA, 11 bp, Homo sapiens
tcccccaggag

SEQ ID NO: 119 - DNA, 11 bp, Homo sapiens
agcccaaagtg

SEQ ID NO: 120 - DNA, 11 bp, Homo sapiens
actaccataac

SEQ ID NO: 121 - DNA, 11 bp, Homo sapiens
tacaaatcgtt

SEQ ID NO: 122 - DNA, 11 bp, Homo sapiens
ttgggtgaaaa

SEQ ID NO: 123 - DNA, 11 bp, Homo sapiens
cattatccaaa

SEQ ID NO: 124 - DNA, 11 bp, Homo sapiens
agaaaccacgg

SEQ ID NO: 125 - DNA, 11 bp, Homo sapiens
accaaaaccac

SEQ ID NO: 126 - DNA, 10 bp, Homo sapiens
tgaaataaac

SEQ ID NO: 127 - DNA, 10 bp, Homo sapiens
tttggtttcc

SEQ ID NO: 128 - DNA, 11 bp, Homo sapiens
gtggagacgga

SEQ ID NO: 129 - DNA, 11 bp, Homo sapiens
tttgtgttgta

SEQ ID NO: 130 - DNA, 11 bp, Homo sapiens
ttatgtttaat

SEQ ID NO: 131 - DNA, 11 bp, Homo sapiens
tggaaatgacc

SEQ ID NO: 132 - DNA, 11 bp, Homo sapiens
tgccacacagt

SEQ ID NO: 133 - DNA, 11 bp, Homo sapiens
gatgaggagac

SEQ ID NO: 134 - DNA, 11 bp, Homo sapiens
atcaaaggttt

SEQ ID NO: 135 - DNA, 11 bp, Homo sapiens
agtcacatagt

SEQ ID NO: 136 - DNA, 11 bp, Homo sapiens
ttcggttggtc

SEQ ID NO: 137 - DNA, 11 bp, Homo sapiens
ccccacacggg

SEQ ID NO: 138 - DNA, 11 bp, Homo sapiens
ggcttgccttt

SEQ ID NO: 139 - DNA, 11 bp, Homo sapiens
atcccttcccg

SEQ ID NO: 140 - DNA, 11 bp, Homo sapiens
tctcacgtctc

SEQ ID NO: 141 - DNA, 11 bp, Homo sapiens
ctagcgtttta

SEQ ID NO: 142 - DNA, 11 bp, Homo sapiens
gtggctgacgc

SEQ ID NO: 143 - DNA, 11 bp, Homo sapiens
ctcttaaaaaa

SEQ ID NO: 144 - DNA, 11 bp, Homo sapiens
tgggaagaggg

SEQ ID NO: 145 - DNA, 11 bp, Homo sapiens
gtttaaggatg

SEQ ID NO: 146 - DNA, 11 bp, Homo sapiens
ctttgttttgc

SEQ ID NO: 147 - DNA, 11 bp, Homo sapiens
attgccaatct

SEQ ID NO: 148 - DNA, 11 bp, Homo sapiens
tgttgaaaaaa

SEQ ID NO: 149 - DNA, 11 bp, Homo sapiens
acaaaaaggcc

SEQ ID NO: 150 - DNA, 11 bp, Homo sapiens
aagatgcacac

SEQ ID NO: 151 - DNA, 11 bp, Homo sapiens
gtagaggaaaa

SEQ ID NO: 152 - DNA, 11 bp, Homo sapiens
ttgttcaaggg

SEQ ID NO: 153 - DNA, 11 bp, Homo sapiens
ctcttcaaaaa

SEQ ID NO: 154 - DNA, 11 bp, Homo sapiens
tattaaaatag

SEQ ID NO: 155 - DNA, 11 bp, Homo sapiens
gaattcaccag

SEQ ID NO: 156 - DNA, 11 bp, Homo sapiens
aaggagaactg

SEQ ID NO: 157 - DNA, 11 bp, Homo sapiens
aatatctgact

SEQ ID NO: 158 - DNA, 11 bp, Homo sapiens
tcagtgaccag

SEQ ID NO: 159 - DNA, 11 bp, Homo sapiens
gcaaagtgccc

SEQ ID NO: 160 - DNA, 11 bp, Homo sapiens
taaatacttgt

SEQ ID NO: 161 - DNA, 11 bp, Homo sapiens
gtcactaattt

SEQ ID NO: 162 - DNA, 11 bp, Homo sapiens
ataacctgcag

SEQ ID NO: 163 - DNA, 11 bp, Homo sapiens
tgcatctgtgc

SEQ ID NO: 164 - DNA, 11 bp, Homo sapiens
taaaggcacag

SEQ ID NO: 165 - DNA, 11 bp, Homo sapiens
gaccgcggctt

SEQ ID NO: 166 - DNA, 11 bp, Homo sapiens
actccggtgtg

SEQ ID NO: 167 - DNA, 11 bp, Homo sapiens
cttctcaccta

SEQ ID NO: 168 - DNA, 11 bp, Homo sapiens
tcgtgctttgt

SEQ ID NO: 169 - DNA, 11 bp, Homo sapiens
gagcagtgctg

SEQ ID NO: 170 - DNA, 11 bp, Homo sapiens
ctctaaaaaaa

SEQ ID NO: 171 - DNA, 11 bp, Homo sapiens
gaaacccggta

SEQ ID NO: 172 - DNA, 11 bp, Homo sapiens
aacacagtgcc

SEQ ID NO: 173 - DNA, 2565 bp, Homo sapiens
tcgcgatgctgctgcgcctgttgctggcctgggcggccgcagggcccacactgggccaggacccctgggctgctgagccccgtgccgcctgcggccccagcagctgctacgctctcttcccacggcgccgcaccttcctggaggcctggcgggcctgccgcgagctggggggcgacctggccactcctcggacccccgaggaggcccagcgtgtggacagcctggtgggtgcgggcccagccagccggctgctgtggatcgggctgcagcggcaggcccggcaatgccagctgcagcgcccactgcgcggcttcacgtggaccacaggggaccaggacacggctttcaccaactgggcccagccagcctctggaggcccctgcccggcccagcgctgtgtggccctggaggcaagtggcgagcaccgctggctggagggctcgtgcacgctggctgtcgacggctacctgtgccagtttggcttcgagggcgcctgcccggcgctgcaagatgaggcgggccaggccggcccagccgtgtataccacgcccttccacctggtctccacagagtttgagtggctgcccttcggctctgtggccgctgtgcagtgccaggctggcaggggagcctctctgctctgcgtgaagcagcctgagggaggtgtgggctggtcacgggctgggcccctgtgcctggggactggctgcagccctgacaacgggggctgcgaacacgaatgtgtggaggaggtggatggtcacgtgtcctgccgctgcactgagggcttccggctggcagcagacgggcgcagttgcgaggacccctgtgcccaggctccgtgcgagcagcagtgtgagcccggtgggccacaaggctacagctgccactgtcgcctgggtttccggccagcggaggatgatccgcaccgctgtgtggacacagatgagtgccagattgccggtgtgtgccagcagatgtgtgtcaactacgttggtggcttcgagtgttattgtagcgagggacatgagctggaggctgatggcatcagctgcagccctgcaggggccatgggtgcccaggcttcccaggacctcggagatgagttgctggatgacggggaggatgaggaagatgaagacgaggcctggaaggccttcaacggtggctggacggagatgcctgggatcctgtggatggagcctacgcagccgcctgactttgccctggcctatagaccgagcttcccagaggacagagagccacagataccctacccggagcccacctggccacccccgctcagtgcccccagggtcccctaccactcctcagtgctctccgtcacccggcctgtggtggtctctgccacgcatcccacactgccttctgcccaccagcctcctgtgatccctgccacacacccagctttgtcccgtgaccaccagatccccgtgatcgcagccaactatccagatctgccttctgcctaccaacccggtattctctctgtctctcattcagcacagcctcctgcccaccagccccctatgatctcaaccaaatatccggagctcttccctgcccaccagtcccccatgtttccagacacccgggtcgctggcacccagaccaccactcatttgcctggaatcccacctaaccatgcccctctggtcaccaccctcggtgcccagctaccccctcaagccccagatgcccttgtcctcagaacccaggccacccagcttcccattatcccaactgcccagccctctctgaccaccacctccaggtcccctgtgtctcctgcccatcaaatctctgtgcctgctgccacccagcccgcagccctccccaccctcctgccctctcagagccccactaaccagacctcacccatcagccctacacatccccattccaaagccccccaaatcccaagggaagatggccccagtcccaagttggccctgtggctgccctcaccagctcccacagcagccccaacagccctgggggaggctggtcttgccgagcacagccagagggatgaccggtggctgctggtggcactcctggtgccaacgtgtgtctttttggtggtcctgcttgcactgggcatcgtgtactgcacccgctgtggcccccatgcacccaacaagcgcatcactgactgctatcgctgggtcatccatgctgggagcaagagcccaacagaacccatgccccccaggggcagcctcacaggggtgcagacctgcagaaccagcgtgtgatggggtgcagacccccctcatggagtatggggcgctggacacatggccggggctgcaccagggacccatgggggctgcccagctggacagatggcttcctgctccccaggcccagccagggtcctctctcaaccactagacttggctctcaggaactctgcttcctggcccagcgctcgtgaccaaggatacaccaaagcccttaagacctcagggggcgggtgctggggtcttctccaataaatggggtgtcaaccttaaaaaaaaaaaaaaaaaaaaaaaaaaa

SEQ ID NO: 174 - DNA, 2832 bp, Homo sapiens
atgcctgcttctctcgctttgttgcagccccgagccatgatgaagactttgtccagcgggaactgcacgctcagtgtgcccgccaaaaactcataccgcatggtggtgctgggtgcctctcgggtgggcaagagctccatcgtgtctcgcttcctcaatggccgctttgaggaccagtacacacccaccatcgaggacttccaccgtaaggtatacaacatccgcggcgacatgtaccagctcgacatcctggatacctctggcaaccaccccttccccgccatgcgcaggctgtccatcctcacaggggatgtcttcatcctggtgttcagcctggataaccgggagtccttcgatgaggtcaagcgccttcagaagcagatcctggaggtcaagtcctgcctgaagaacaagaccaaggaggcggcggagctgcccatggtcatctgtggcaacaagaacgaccacggcgagctgtgccgccaggtgcccaccaccgaggccgagctgctggtgtcgggcgacgagaactgcgcctacttcgaggtgtcggccaagaagaacaccaacgtggacgagatgttctacgtgctcttcagcatggccaagctgccacacgagatgagccccgccctgcatcgcaagatctccgtgcagtacggtgacgccttccaccccaggcccttctgcatgcgccgcgtcaaggagatggacgcctatggcatggtctcgcccttcgcccgccgccccagcgtcaacagtgacctcaagtacatcaaggccaaggtccttcgggaaggccaggcccgtgagagggacaagtgcaccatccagtgagcgagggatgctggggcggggcttggccagtgccttcagggaggtggccccagatgcccactgtgcgcatctccccaccgaggccccggcagcagtcttgttcacagaccttaggcaccagactggaggcccccgggcgctggcctccgcacattcgtctgccttctcacagctttcctgagtccgcttgtccacagctccttggtggtttcatctcctctgtgggaggacacatctctgcagcctcaagagttaggcagagactcaagttacaccttcctctcctggggttggaagaaatgttgatgccagaggggtgaggattgctgcgtcatatggagcctcctgggacaagcctcaggatgaaaaggacacagaaggccagatgagaaaggtctcctctctcctggcataacacccagcttggtttgggtggcagctgggagaacttctctcccagccctgcaactcttacgctctggttcagctgcctctgcaccccctcccacccccagcacacacacaagttggcccccagctgcgcctgacattgagccagtggactctgtgtctgaagggggcgtggccacacctcctagaccacgcccaccacttagaccacgcccacctcctgaccgcgttcctcagcctcctctcctaggtccctccgcccgacagttgtgctttgttgtggttgcagctgttttcgtgtcatgtatagtagtagaaatggaaatcattgtactgtaaaagcctagtgactccctccttggccaggccctcacccagttcagatccacggcctccacccgggacgccttcctcctctgctcccaaacagggtttccgtggcctgtttgcagctagacattgacctccgccattgagctccacggtttacagacaattgcacaagcgtggggtgggcaggccaggactgcttttttttaatgctcccatttcacagaggataccaccgagactcggaggggacacgatgagcaccaggccccacctttgtcccctagcaaattcagggtacagctccacctagaaccaggctgccctctactgtgctcgttcctcaagcatttattaagcacctactgggtgctgggttcactgtgtcctaggaaaccaagagggtccccagtcctggcctctgcccgcccctgctgccccaccaccttctgcacacacagcggtggggaggcggggaggagcagctgggacccagaactgagcctgggagggatccgacagaaaagctcagggcgggtcttctccttgtgcccgggattgggctatgctgggtaccaccatgtactcaggcatggtgggttttgaacccataaaccaaaggcccttgtcatcagctcttaacaagtatattttgtattttaatctctctaaacatattgaagttttagggccctaaggaaccttagtgatcttctattgggtctttctgaggttcagagagggtaagtaacttcctccaggtcacacagcaagtctgtgggtggcagaagcaagctagcgctgggcattcagtacataccacgatgtgctccctctcttgatgcttggcccctggggccttcagggctttgggacatcttgtcctcaaccctctccctagatcagtctgtgagggtccctgtagatattgtgtacaccatgcccatgtatatacaagtacacacagatgtacacacagatgtacacatgctccagccccagctctgcatacctgcacctgcaccccagccttggcccctgcctgcgtctgtgctcaaagcagcagctccaaccctgcctctgtccccttccccacccactgcctgagccttctgagcagaccaggtaccttggctgcaccggtgtgtggcccgctctcacccaggcacagccccgccaccatggatctccgtgtacactatcaataaaagtgggtttgttacaaaaaaaaaaaaaaaaaaaaaaaaaaaaaaa

SEQ ID NO: 175 - DNA, 4640 bp, Homo sapiens
gcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaataccaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagatgctccagtggctttgaccgctatcgccaggagtgggatgggactatgggctgtgcacaggaggcagaggggcaggatgtgcgaggacttccagggatgaggaccacgacttcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgttcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaaaaaaaaaaaaaaaaaaaaagcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaataccaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttrtttaaggggcctttacctattcctgcacctaggctaggataactttagagcactgasataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaaaaaaaaaaaaaaaaaaaaaaaaaaa

SEQ ID NO: 176 - DNA, 5540 bp, Homo sapiens
aattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgttctgacggttccatcctggccatcgccctgctgatcctgttcctgctcctagccctggctctcctctggtggttctggcccctctgctgcactgtgattatcaaggaggtccctccaccccctgccgaggagagtgaggaagaagatgatgatggtctgcctaagaaaaagtggccaacggtagacgcctcttattatggtgggagaggcgttggaggcattaaaagaatggaggttcgttggggagaaaagggctccacagaagaaggtgctaagttggaaaaggcaaagaatgcaagagtcaagatgccggagcaggaatatgaattccctgagccgcgaaatctcaacaacaatatgcgtcggccttcttccccccggaagtggtactctccaatcaagggaaaactcgatgccttgtgggtcctactgaggaaaggatatgatcgtgtgtctgtgatgcgtccacagccaggagacacggggcgctgcatcaacttcaccagggtcaagaacaaccagccagccaagtacccactcaacaacgcctaccacacctcctcgccgcctcctgcccccatctacactcccccacctcctgcgccccactgccctcccccgccccccagcgcccctacccctcccatcccgtccccaccttccacccttccccctcctccccaggctccacctcccaacagggcacctcctccctcccgccctcctccaaggccttctgtctagagcccaaagttcctgctctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatgttgctatgttgatgtgtaagtgaaatcagttgtgtgcaatagacaggggcgtattcatgggagcatcagccagtttctaaaacccacaggccatcagcagctagaggtggctggctttggccagacatggaccctaaatcaacagacaatggcattgtcgaagagcaacctgttaatgaatcatgttaaaaatcaaggtttggcttcagtttaaatcacttgaggtatgaagtttatcctgttttccagagataaacataagttgatcttcccaaaataccatcattaggacctatcacacaatatcactagttttttttgtttgtttgttttttgttttttttcttggtaaagccatgcaccacagacttctgggcagagctgagagacaatggtcctgacataataaggatctttgattaacccccataaggcatgtgtgtgtatacaaatatacttctctttggcttttcgacatagaacctcagctgttaaccaaggggaaatacatcagatctgcaacacagaaatgctctgcctgaaatttccaccatgcctaggactcaccccatttatccaggtctttctggatctgtttaatcaataagccctataatcacttgctaaacactgggcttcatcacccagggataaaaacagagatcattgtcttggacctcctgcatcagcctattcaaaattatctctctctctagctttccacaaatcctaaaattcctgtcccaagccacccaaattctcagatcttttctggaacaaggcagaatataaaataaatatacatttagtggcttgggctatggtctccaaagatccttcaaaaatacatcaagccagcttcattcactcactttacttagaacagagatataagggcctgggatgcatttattttatcaataccaatttttgtggccatggcagacattgctaatcaatcacagcactatttcctattaagcccactgatttcttcacaatccttctcaaattacaattccaaagagccgccactcaacagtcagatgaacccaacagtcagatgagagaaatgaaccctacttgctatctctatcttagaaagcaaaaacaaacaggagtttccagggagaatgggaaagccagggggcataaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccaaccctgccgcattgtctaatttttagaacactaggcttcttctttcatgtagttcctcataagcaggggccagaatatctcagccacctgcagtgacattgctggacccctgaaaaccattccataggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgttttttttttattaaagccaaatttgtgttgtatatattcgtattccatgtgttagatggaagcatttcctatccagtgtgaataaaaagaacagttgtagtaaattattataaagccgatgatatttcatggcaggttattctaccaagctgtgcttgttggtttttcccatgactgtattgcttttataaatgtacaaatagttactgaaatgacgagacccttgtttgcacagcattaataagaaccttgataagaaccatattctgttgacagccagctcacagtttcttgcctgaagcttggtgcaccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaatcaaaaaaaaaaaaaaaaaaaa

SEQ ID NO: 177 - protein, 757 aa, Homo sapiens
MLLRLLLAWAAAGPTLGQDPWAAEPRAACGPSSCYALFPRRRTFLEAWRACRELGGDLATPRTPEEAQRVDSLVGAGPASRLLWIGLQRQARQCQLQRPLRGFTWTTGDQDTAFTNWAQPASGGPCPAQRCVALEASGEHRWLEGSCTLAVDGYLCQFGFEGACPALQDEAGQAGPAVYTTPFHLVSTEFEWLPFGSVAAVQCQAGRGASLLCVKQPEGGVGWSRAGPLCLGTGCSPDNGGCEHECVEEVDGHVSCRCTEGFRLAADGRSCEDPCAQAPCEQQCEPGGPQGYSCHCRLGFRPAEDDPHRCVDTDECQIAGVCQQMCVNYVGGFECYCSEGHELEADGISCSPAGAMGAQASQDLGDELLDDGEDEEDEDEAWKAFNGGWTEMPGILWMEPTQPPDFALAYRPSFPEDREPQIPYPEPTWPPPLSAPRVPYHSSVLSVTRPVVVSATHPTLPSAHQPPVIPATHPALSRDHQIPVIAANYPDLPSAYQPGILSVSHSAQPPAHQPPMISTKYPELFPAHQSPMFPDTRVAGTQTTTHLPGIPPNHAPLVTTLGAQLPPQAPDALVLRTQATQLPIIPTAQPSLTTTSRSPVSPAHQISVPAATQPAALPTLLPSQSPTNQTSPISPTHPHSKAPQIPREDGPSPKLALWLPSPAPTAAPTALGEAGLAEHSQRDDRWLLVALLVPTCVFLVVLLALGIVYCTRCGPHAPNKRITDCYRWVIHAGSKSPTEPMPPRGSLTGVQTCRTSV

SEQ ID NO: 178 - protein, 278 aa, Homo sapiens
MPASLALLQPRAMMKTLSSGNCTLSVPAKNSYRMVVLGASRVGKSSIVSRFLNGRFEDQYTPTIEDFHRKVYNIRGDMYQLDILDTSGNHPFPAMRRLSILTGDVFILVFSLDNRESFDEVKRLQKQILEVKSCLKNKTKEAAELPMVICGNKNDHGELCRQVPTTEAELLVSGDENCAYFEVSAKKNTNVDEMFYVLFSMAKLPHEMSPALHRKISVQYGDAFHPRPFCMRRVKEMDAYGMVSPFARRPSVNSDLKYIKAKVLREGQARERDKCTIQ

SEQ ID NO: 179 - protein, 1002 aa, Homo sapiens [sequence omitted]

SEQ ID NO: 180 - DNA, 5680 bp, Homo sapiens
gggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctacaaaaaaaaaaaaaaaaaaaaaaaaaaaaaaa

SEQ ID NO: 181 - DNA, 2157 bp, Homo sapiens
ggcggcggcatggcgaggttcccgaaggccgacctggccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgaggaggatacagaccacaattactatatatctcgaatatatggtccatctgattctgccagccgggatttatgggtgaacatagaccaaatggaaaaagataaagtgaagattcatggaatattgtccaatactcatcggcaagctgcaagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccataggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcgttggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgagggatcgacacctttggttcaaatgttctctgatgtctcaaagataactgttttccaaagcctgaaccctttcactcaaaagagcaatgatgaatgtctcaagattgctaagaaaaacagcccatgcaagagtgagaacaaacacaaaataagagattttctacattttcaaaaaaaaaaaaaaaaaaaaaaaa

SEQ ID NO: 182 - DNA, 2535 bp, Mus musculus
gtcgcgatgctgctgcgcctgctgctggcctgggtggccgcggtgcccgcactgggccaggtcccctggacgccggagcctcgagccgcgtgcggccccagcagctgctacgcgctctttccccggcgccgcacattcctggaagcttggcgggcgtgccgcgaattggggggcaacctggccacaccgcggaccccagaggaggcccagcgtgtggacagcctggtgggggtcgggccggccaacgggctgctatggattgggttgcagcggcaggctaggcaatgccagccgcagcgcccactgcggggcttcatatggaccacgggagaccaggacaccgccttcaccaactgggcccagccggctacggaaggaccctgcccagcccagcgctgtgcagcccttgaggccagcggagagcatcgctggctcgaaggctcgtgcacactggctgtcgatggctacctctgccagtttggttttgagggtgcctgccctgccttgccgcttgaggtgggtcaggccggtcccgctgtctacaccacacccttcaacctggtttccagcgagttcgaatggctgccctttggctccgtggcagctgtgcagtgccaagctggcaggggagcttctctgctgtgcgtgaaacagccttcaggtggcgtgggctggtcccagactggcccgctgtgcccagggactggctgtggtcctgacaatgggggttgcgaacatgagtgtgtggaagaggtggacggtgctgtgtcctgccgctgcagtgaaggcttccgtctagcagcagatgggcacagttgtgaagacccctgtgcccaggccccctgtgagcagcagtgtgaacctggagggccacaaggctatagctgccactgtcgccttggcttccggccagctgaggatgatccacaccgctgcgtggacacggatgagtgccagattgctggtgtgtgccagcagatgtgtgtcaactatgttggtggctttgagtgttactgcagcgagggtcacgagcttgaggcagatggtatcagctgtagccctgcaggagccatgggtgcccaggcttcccaggatctcagagatgagttgctggatgatggagaagaaggggaggatgaagaggagccctgggaggactttgatggcacctggacagaggaacaggggatcctatggctggcacctacacatccacctgactttggcctgccctataggcccaacttcccacaggatggagagcctcagagattgcacctggagcctacctggccacccccacttagtgcccccaggggcccctaccactcctcagtggtgtctgccacacggcccatggtgatctctgccactcgacccacactaccttctgcccacaagacctctgttatttcagctacacgcccacccctgagccctgtccacccacctgccatggcccctgccacacctccagctgtgttctctgagcaccagatccccaaaatcaaggccaattatccagacctgccttttggccacaagcctgggataacctcggccactcacccagcacggtctcctccgtaccagccccccattatctcaaccaactatccccaagtcttccctccccaccaggcccctatgtctccagatacccacactatcacttatttgcctccagtcccccctcaccttgatcctggggataccacttctaaagcccatcaacaccctttgctcccagatgctccaggtatcagaacccaggccccccagctttctgtctcagctctccagccccctcttcctaccaactccaggtcttctgtccatgaaactcctgtgcctgctgccaaccagcccccagccttcccttcttctcccctcccccctcagaggcccactaaccagacctcatctatcagccctacacattcctattccagagcccctctagtcccaagggaaggagttcccagtcccaaatcagtgccacagctgccctcggtgccctccacagcagctccaacagccctggcagagtcaggtcttgcaggccaaagccaaagggatgaccgctggctgctggtggcactcctggtgccaacatgtgtcttcttggtggtgctgcttgccctgggcattgtgtactgcactcgctgtggctcccacgcacccaacaagcggatcacggactgctatcgctgggtcacacatgctgggaacaagagctcaacagaacccatgccccccagaggcagccttacaggggtacagacctgtagaaccagtgtgtgatggggtgcagatgcccctttgtgggatagaagaaaaggacttgctttggacacatggctgagaccacaccaaggacttatgggggctgcccagctgacagaggaggttctgttctttgagcccagcatccatggcaaaggacacaccaggactccaggacctcaaggggtgggtgctgggatcttctccaataaatggggtgccaacctcacccaaaaaaaaaaaaaaaaa

SEQ ID NO: 183 - DNA, 5520 bp, Mus musculus
gggcgcccgggactcccgctgagcactcctcccgcacgcccgggtccctccggccggcgagccgtccggcccctgcgctgtaggtccccgcggggcgatgggttgatgggcgcggggggacgcaggatgccggtgcctcccgcgcgtttgctgctgctgccgctgctgccttgtcttctgctcctggctcctggaactcggggtgcgcctggctgcccggtccctatccgcggttgcaagtgctctggggagcggcccaagggactaagtggcggcgcccacaacccggctcgaaggagggtggtgtgcggcggtggggatctccccgaacctccagatcccggccttctgccaaacggcaccatcaccttgctcttgagcaacaacaagattactgggctccgcaatggatccttcttgggactgtccctgttggagaagttggacctgaggagcaatgtcatcagcactgtgcagcctggagccttcctaggtctgggagagctaaaacgcttagatctctccaacaatcggattggctgtctcacctctgagacatttcaagggctccctagacttctcagactaaacatatctggaaacatctactctagtctgcaacctggggtctttgatgagctgccagcccttaagattgtggactttggtactgagtttctgacctgtgactgccgcctgcgctggctgctgccctgggcccggaatcactccctgcagctgtctgagcgcacactctgtgcctaccccagtgccctgcacgcccatgccctgagcagcctccaggagtcccagcttcgctgtgaaggggccctggaactgcacacccactacctcatcccatcccttcgccaagtggtgttccagggtgaccgcctgcccttccagtgctcagccagctacttgggcaacgatacccggatccactggtaccacaatggggctcctatggagagcgatgagcaggccggcatcgtccttgctgaaaaccttatccatgattgcaccttcatcaccagtgagctgaccctgtctcacattggtgtgtgggcctctggtgaatgggagtgctccgtgtccacagtccaaggcaacaccagcaagaaggtggagatagtagtgctggagacctctgcctcctactgccctgcagagcgggtgaccaacaaccgtggggacttcaggtggccccgaaccttggctggcatcacggcttaccagtcctgtttacagtaccccttcacctctgtgcccttgagtgggggagccccgggtacccgagcctcacgcaggtgtgaccgagctggccgctgggagccaggggactactcgcactgtctgtacaccaatgacatcactcgggtgctctacacctttgtgctgatgcccatcaacgcctccaatgcattgacgttggcccaccagctgcgagtgtataccgcagaggccgccagcttctcagacatgatggacgtggtctatgtggctcagatgatccagaagtttttgggttacgttgaccagatcaaggagctggtggaggtgatggtggacatggccagcaacctgatgctggtggatgagcaccttctgtggctggcccagagagaagacaaagcctgcagtggcattgtgggtgccctggagcgaatcggaggagctgctcttagcccccatgcccagcacatctctgtgaattcaagaaatgtggcactggaggcctacctcatcaagcctcacagctacgtgggtctgacttgcacggctttccagaggagggaggtaggagtgtcgggtgcacagccaagcagcgtcggccaggatgccccagtggagcccgaacccctagctgatcagcagcttaggttccgctgcaccactgggaggcccaacatttctctgtcatccttccacatcaagaatagcgtggccctggcctccatccagctgccccccagcctgttctcaacccttccggctgccctggctcccccagtccctccagattgcaccctgcaactgctggtcttcagaaatggccgtcttttccgcagccacggcaacaacacttcccgtcctggagcagctgggcctggcaagaggcgtggtgtggccaccccagtcatatttgcaggaaccagtggctgtggtgtgggaaacttgacggagcccgtggctgtgtcactgaggcactgggctgaaggagctgaccccatggcagcttggtggaaccaggacgggcctggaggctggagttctgaaggctgcaggctccgctacagccagcccaacgtcagctccctgtactgccagcacttgggcaatgtggccgtgcttatggagctgaatgcattcccgcgggaggcaggaggctctggggctgggttgcatcccgtcgtgtacccctgcacggctttgctgctactctgtctcttctccaccatcatcacgtacatcctcaaccacagctccatccacgtgtcccggaagggttggcacatgctgctgaacctttgtttccatatggccatgacctctgctgtcttcgtggggggcgtcacgctcaccaactaccaaatggtttgtcaagcggtgggcatcactctgcactactcttccttgtcgtcactgctctggatgggggtcaaggctcgagtcctccacaaggagcttagttggagggcaccccctctggaagaaggggaagcagctccgcctggtcctcgccccatgctccggttctacttgattgctggagggatccccctcataatctgcggcatcaccgctgcggtcaacatccacaactaccgggaccacagtccctattgttggctggtgtggcgtccaagccttggtgccttctacataccggtggcgttgattctgcctatcacctggatctacttcttgtgtgcaggccttcacttacggagccatgtggcccagaatccaaagcagggtaacaggatctctctggagccaggggaagagctgaggggttccaccaggctcaggagtagtggcgtcctcctgaatgactctggttctcttttggctacagttagcgcaggagtagggacacctgcgcccccagaggatggtgatggcgtatattctcctggagtccagctgggggcgctgatgaccacgcatttcctgtacctggctatgtgggcttgtggtgccttggcggtgtctcagcgctggctgccccgagtggtgtgtagctgtctgtacggcgtggcagcttcagctcttggtctgtttgtcttcactcaccactgtgccagacgtagagatgtccgggcttcctggcgcgcctgctgccctcctgcttcgccctcggcctcccatgtcccagcccgggccctgccgactgctacagaggatggatccccagtgttgggggagggaccagcctctctcaagtcctccccaagtggcagcagtggccgcgcgccgccacccccctgcaaactcaccaatctgcaggtggcccagagtcaggtgtgcgaggcaagcgtggccgcccgcggagatggagagccagagcccaccggctcccgtggcagcctagctccccggcaccataacaacctgcatcatgggcgccgagtacacaagagtcgggccaaggggcaccgagccggagagactggtggtaagagccggctcaaggcgttgcgcgcgggcacgtccccaggagctcccgagctgttgtccagtgagagcggcagtttgcacaacagcccgtctgacagctacccgggcagcagccgcaacagtccaggcgacggtcttccactcgagggtgagcccatgcttacgccgtcggagggcagtgacacaagcgccgcgccaatcgctgagacggggcgccccgggcagcgccgcagcgccagccgtgacaacctcaagggcagcggcagcgcgctggagagggagagcaagcgccgctcctatccgctcaacactaccagtcttaacggtgcccccaaagggggcaagtatgaggatgccagtgtaactggtgcagaggccatagcgggaggctccatgaagactggcctctggaaaagcgagaccaccgtctaggtccagatttaggatgggcgggtcacgcgggcttgtttactcccaaatcctcttgggcggtccaagccgtctactgatgtgtatgtaggtttaaggcggccatgctgatgctgcccttgagtccaccatcattagttacccaggctagggaaaggggagggaggcagatgcttgcccctactgtggactatccctcagcagtagcgacagacaatcccagaccagttttggtggccaagttcttggtatcctgccaggtaggcataaaacatccatcggtccctagggtaacccataaactgagttgaagagcccagcccaggtaggctcaggaaatgagagggagaccggggaactgggttctccacaccagcccggcaaggtatcctgtgactgccaagatcccaggcctctctcccagttttggcttgggaaaccatcccagcaggtgagccagggggcgtaacaggtgctgcctttcagattaactatgcaagggggatgggggtgggaggggtagggcagtgtggtgggcagctctagagatgagcttgtccctcaggaggcaggcaggtgggaaaaggtgcattagggagacagaatccctaactatgggagtggtacacagtttttccagcagagttcacagcaaaccctgaacccccacacacctgggaagtgatactgccagcaggtgccttaagactcaaggggagggagctgatatgtggatctcacaacctatacagtggtctgcaagtggctccacttagctgcttaattataatacccactgtctgttcccagccctccaactccgggggactgaggggaaatgcctccatgaggctcctgtggcaaagccatgctaataatctgacttctaacctcagttagaaacccaaaatgccaaaccacctcctaactcgctgaaacccaaccacactctgaggcagcgcctgggtccaggctgctcaagagcctatgcttccagcccccattttcctcaactcaagatgccttttaatacagaactacatggaagtagaggaacccttgggcactgggaagtagcagggatcccagctctgatcaagtgagaggacagagcagggaagacgccatactcgctgagatgggtcccattatttatgctttgctgcacagacactattagaggaaaagctttgtattactctcccacgtgagctgctgctgtttaccctgccaatgccttagcactggagagctttttgcaatatgctggggaaaggggagggaggggatgaagtgccaaagaaaacacattttaaaagctctggttttatacaatagaatgttttccagcagatgcctctttgttttaatatattaaaatcttgcaaaaaaaaaaaaaaaaaaaaa

SEQ ID NO: 184 - DNA, 2833 bp, Mus musculus
cggggctgctccctctgcagccgccgccgccgccgcgcagacccggaggtcgtccgcgcccaccatgcgagctcagctctggttgctgcagttgctgctactccgcggggccgcgcgcgcgctcagtcccgcaacacccgcaggtcacaatgaaggtcaagactctgcatggactgccaagaggaccaggcaaggctggagtcggagaccccgagagagccccgcgcaggtgttgaagccaggcaagacccagctaagccaggacttgggtgggggctccctggccatcgacacacttccggacaacaggactcgggtggtggaggacaaccataactactacgtgtcccgtgtctacggccctggtgagaaacaaagccaggatctgtgggtggacctggctgtggccaaccggagtcatgtgaagatccacaggatcctctccagttctcaccgacaggcttcaagagtggtcttgtcctttgatttccctttctatgggcatcctctgcggcagatcaccatagcaaccggaggcttcatcttcatgggggacatgctccaccggatgctcacagctacgcagtatgtggcacccctgatggccaacttcaaccccggctactctgacaactccacggttgcttactttgacaatgggaccgtttttgtggttcagtgggatcatgtttacctccaggaccgggaggacaggggcagcttcaccttccaggcggccctacaccgagatggccgcattgtcttcggctacaaagagatccccatggctgtcctggatatcagctctgcccagcaccctgtcaaggcaggcctgtccgacgctttcatgattctcaattcatccccagaggtgccagagtctcagagacggaccattttcgaataccaccgtgtggaactggactccagcaagatcaccaccacctcggccgtggagttcaccccgttgccaacctgcctccagcatcagagttgcgacacctgcgtgtcctcgaatctaaccttcaactgcagctggtgccatgtcctgcagaggtgttccagtggctttgaccgataccgccaagaatggctgacctacggctgtgcccaggaggcagaaggcaagacatgcgaggacttccaggatgatagccactactcagcctcccctgacagctccttcagcccctttaatggcgactccactacctcttcctccctcttcattgacagcctcaccacagaagatgacaccaagttgaatccctacgcagaaggagacggccttccggaccactcatctccgaagtccaagggtcctcccgtgcacctgggcaccatcgtgggtatcgtgcttgctgtactcctggtagcggccatcatcctggctgggatttacatcagtggccaccctaattccaatgctgcactcttcttcatcgagcggagacctcaccactggccagccatgaagttccataaccaccccaaccactctacctacaccgaggtagagccctccgggcacgagaaggaaggcttcgtggaggccgagcagtgctgagagagcatcgggccagagacctggagatggcatgaaagacaagtcacagcacagagaagtgattttttttcctggcttcctcggagctggccctgggccaggaagacaagacaacagcttgtggtgccaacactacagtttggtctgcacaccccatttaaagggggctcagtaatacaactgcgaaggctccttggggaacactgacctcaagagttccctgtttcaatgggaggaggcttcgtttggggtctctcagtggtctgcagctatggcggagcccctgcccactggagacagcctcctgtgttcctcctgctcactgaagcccacactgggccattgcattccggggtctatagattcaagagctggtcttgctagctatggagtcagtgcccttggctccaaactttgtggcttagaagcctgaagaaggggatcccttccctccgagagcgcttaaccctgagatgcgctaacagagagaaaagtaaccttggggaacttgcatttttctggccttggtcctttgcttcattgttttttttgcagaggccggggccaacatccgagcactgtagcctgcagctcattctgtaccctgccctgccctgcccctcagcctccaccctgcaagctggtcttgcatggctgccagtaatgagtggggcccttactgtgccatgtgtctggtgcctgcattactcgttaacctgttctgttatcaacggcagtagtttccttcaaagagggggacaatttacctggctcctgttttaacttggctgaccagagtcgagttcttgtaaccattaaaaacaactagggggccgggtgtggtggtgctcacactcaggaggctgagctctgagatcaaggccagcctggtctacagagagagcctgtcttgaagaaacaagacaaatggggggctagaggtttccctgagacacccctgccttagcaaggggctccagttggatcccgttgaagcacggtggccgcgaaggtagggcagagaaatctggtatgggagggagagaccttgacctggaaagcggcctccatctctccagctctgcaaagagctttgggaactgggagttgacgttcccacactcagcctggttttaagggacttctgtccccgtggtggaccaggacggcttctaaaggacaatgaaaacctagagctcaccttcatcccaaagaagcgtcatcagcaaataaataaggtatagccctcaaaaaaaaaaaaaaaaa

SEQ ID NO: 185 - DNA, 2009 bp, Mus musculus
gagagaggtcgcggcagcggcatggcaaggttccggagggccgacctggccgcagcaggagttatgttactttgtcactttttaacagaccggttccacttcgcccacggggagcctggacaccataccaatgattggatttatgaagttacaaacgcttttccttggaatgaagagggggtagaagtggactctcaagcatacaaccacaggtggaaaagaaatgtggacccttttaaggcagtagacacaaacagagccagcatgggccaagcctctccagagtccaaagggttcactgacctgctactggatgacggacaggacaataacacccagatagaggaggacacggatcacaattactacatttctcggatatatggtccagcggattctgccagccgggatctgtgggttaacatagaccaaatggaaaaagacaaagtgaagattcacgggatactttccaacactcatcggcaagctgcaagagtgaatctgtccttcgattttccattttatggtcattttctaaatgaagtcactgtggcaactgggggtttcatatatactggagaagttgtacatcgaatgctcacagctacacagtatatagctcctttaatggcaaattttgatcccagtgtatccagaaattcaactgtcagatattttgataatggcacagctcttgttgtccagtgggaccatgtccacctgcaggataattacaacctgggaagcttcacattccaggccacactcctcatggacgggcgcatcatctttggatacaaagaaatccctgtcttggtcacacagataagttctaccaaccatccagtgaaagtcgggttgtctgatgcatttgtcgtggtccacaggatccagcaaatacccaatgttcgaagaagaacaatttatgaatatcaccgagtagaactacaaatgtccaaaattaccaacatctcagctgtggagatgactccacttcccacatgtctccagttcaatggttgtggcccttgtgtgtcctcgcagattggtttcaactgcagttggtgcagcaaacttcaaagatgctccagtggatttgatcgccatcggcaggactgggtggacagtggatgcccggaagaggtacagtcaaaagagaagatgtgtgagaagacagagccaggagagacgtctcaaactaccacgacctcccacacgaccaccatgcaattcagggtcctgaccaccaccaggagagctgtgacatcgcagatgcctaccagcctgcctacagaagatgacacgaagatagccctacatctcaaagacagtggagcctccacagatgacagtgcagctgagaagaaaggaggaaccctccatgcaggcctcattgttggaattctcatcttggtcctcattatagcagcggccattctggtgacagtgtatatgtatcaccatccaacatcagcagccagcatcttcttcattgagagacgcccaagcagatggccagcaatgaagtttcgaagaggctcaggacaccctgcctatgcagaagttgaaccagttggagagaaagaaggttttattgtatcagagcagtgctaaaattttaggacagagcagcaccagtactggcttacaggtgttaagactaaaactttgcttatgcatttaagacaaacagacacacaacccacaaccacacacaaaggagccctaaactgctgtagacagaagggcgacgagatttctggacaagcccagcccaggaacattgaaaggaaaactcagacttgtacaagacaccatgtacaatgattaaagaattccctagtggaatgacatccatggttcacaaggaacatctccggtggacttgccaggagtgtgacgagatgacgatgcttttggtttaggtgcagggttgcaaagaaatcaaggaaaaaaaatatgacaataaataaagctttagttcacaagggaaaaaaaaaaaaaaaaaa

SEQ ID NO: 186 - DNA, 5220 bp, Mus musculus
cggaactgcttcgactgcaaagcttcaagcgcagcctgggagcggcctggtggccctatcccggcagctccacacagcagaacgccctgggtccctgaaactcgaaacccgggctcagaaccagcggaaaccaaagcgaaatccttgaacttctctgaacaattgcttccgggcgtttgctgagagccgggggacctgaccggagcccaggccgcgtatggcgcgcccctgatgtcacacggacgccagcgaggccagcgctccggctgcagcatggaccgcgcggggcgcctgggtgcgggcctgcggggactctgcgtggctgcactcgtgctcgtgtgcgccggacacgggggccgccgcgaggatgggggaccagcttgctacggaggattcgacctctacttcatcctggacaagtcaggaagtgtgctgcaccactggaatgaaatctactacttcgtggagcagttggctcatagattcatcagcccacagctaaggatgtccttcattgtcttctctactcgagggacaactttaatgaaactaactgaggacagggaacagatccgacaaggcctagaagagctccagaaagttctgccaggaggagacacttacatgcacgaaggattcgagagggccagtgagcagatttactatgagaacagtcaaggatacaggacggcgagcgtcatcatcgcgttgacggatggggagctgcacgaggacctcttcttctactcagagagggaggctaaccgatcccgagaccttggtgcgattgtttactgcgttggcgtgaaggatttcaatgaaactcagttggctcggattgcagacagtaaggaccacgtgtttcctgtgaacgacggcttccaggctctccaaggcattatccactcaattttaaagaaatcctgcatcgaaattctggcggctgaaccatccaccatctgcgcgggagagtcctttcaagtggtcgtaagaggaaatggcttccgacatgcccgcaatgtggacagggtcctctgcagcttcaaaatcaatgactcagtcacgctcaatgagaagccctttgctgtggaagacacttatttgctgtgcccagcaccaatcttgaaagaagttggcatgaaagctgcactgcaggtcagcatgaacgacggcctgtccttcatctccagttctgtcatcatcaccaccacacactgttcagacggctccatcctggcgattgctctgctggtcctcttcctgctgctggccctggcgctgctctggtggttctggcccctctgctgcacagtgatcatcaaggaggtccctccaccccctgttgaggagagtgaggaagaagacgatgatggtttgccaaagaagaaatggcccacagtagatgcctcttattatggtggacgcggtgtgggaggcattaaaagaatggaggtccgctggggagaaaagggctccacagaagaaggggcgaagttagaaaaggcaaagaatgcacgagtcaagatgccagagcaagaatatgagttcccagaaccccgaaacctcaacaacaacatgcgccggccttcctcgcctcggaagtggtactcgcccatcaagggaaaactcgatgccttgtgggttctgctgagaaaaggatatgaccgagtgtctgtgatgaggccacagccaggagacacgggacgctgtatcaacttcaccagagtgaagaacagtcagccagccaagtatcccctgaacaacacctaccaccccagctccccacctcccgctcctatctacacacccccaccccctgctccccactgccctcccccagcccccagtgcccccactcctcccattccttccccaccatccactctcccccctcctcctcaggccccaccccctaacagggcacctcccccctcccgacctcctccaaggccttctgtctagaacccaaagtccgagctctgggctgcctgagcaactccagcaggaggcttctctgctgaaagaaagatctgcccagcctatgtggtgagtggcggctgatgtttgcacgatttaaaagcaagtcgtgatgggcagaacaaaatgggcattttgaactgcctgaagacagacaatgagacaataacagtcacattatagcctgtgacccctcacctctagaggaaggttcccgagatggccacattgccacagtgctctcagccagattatgtcccatgaagaccaggaagaaagtgacttccaagaatggaatgcagcattggataagaaacacctggctgagattctgacctcactgatttgactcttgattcttggactgggagccaggccatctccacccctggtaccacccagcaactctgaaaatgtgcagtgtccctagtatgcatcgaataggtatccaactgggatctgcaggttgccttataaagagcatatgctctattctctttcccgaacttcctggtttcccagtgatgagggaaggggaaaggtgttgccatgcttagaagttagaggacgtcagtgctcagcactgatggagaagcgttgatgggagtgtccagctcttacatctagaaatggctggcttcagcaggcacagttcctaaaccaacaagccttgtcattgtcaaaggcaacctactaatgattcaccttaaacatcaaggttgactgtggcataggtcagagctgatcacacagaaccttccccatgaaatcgcaaggttcctcatcttcaaatacccaggaccccagagatttctaaatccagctaagagacagtagtcctgacttggcaagaaaaccattcccagttgttttactctgaaacaggccgttgtatgtatggtatatctctccttggcctttcaacctgctcacaagtattaccagttatgaagcaaggagaaatacatccagtgtgtaatagaaaagctctgcccacaatccccatgtcactcctctacattattctgaagctgcttggtcagtgagccctttaacctcatgtagactctggacactgtcacccaatcatgaaaacagaggtcattgtcaaaggcagtgtatagcctgtacaaaaatgatgcttccttcctcagtttccacaggccccaaaattcctgtcttaggctcctaaacctctaaactttttcctggaacaaaagatataaaacgggcataagtttttatgttttgggctgtgatctccaaagatccttcaagaactcaagttagcctcattcttccagcttgtttagaacagaggcatccaggtgtcatgcactccatagacaccaatccttgttcccaaggcagacattattaatcaatctcagcactagttctcaatttaatccaattatatttttccacagtacttcacatctcttatgacctgttggtcatcagttagaattgagagagataaacactgtttgtaatccctaccttagaaagaaaagcagaggagaatgggggaaccaccagcataaaagttattatctggggaaaatcgacctgaaagaacgcccaagtccaagacctatggtgctgacaccaaagtaacactttcccaagtgtaccccagaccccactcttctccctgtggccaccactccctgcttttcaggagttgtgaaaaagatctccttcacccttactgtgcccccatattagaacaaggcttgtttagtgtagtccttgttaaacaggtgccagaatgtctcagccacctgagatgacattgctgggccccagaaaaccattccaaggagaatgggctccccaggctcagagcatgcaactatgagcccatggcaactgttttgactgctggcagtacaaaacgggccaccccacattacagctgcaggatttgtgcagccataagaaagtatgaaccaagatgctggtgttgctgttcaacaagcatgggcttcggggaaggcagcagactccgagagcaggccttgtgcagtgtcccaaggggctgtggtgaagtgtctgaggaaaaatgaatgctgatacatggtgattctgagaagaatttgcaaggtttgaccttagaatttatggaatgtcttccctggtcattcagaattatggctagaagtttctagaaaccgtcaaggttaatacctttcagagtaggtgattacaggcaggaagagctttgatgtggtttacaaagcccatcagttctgtgtcattccctgtaagcaacaggagatggtggttgtgattagcaaactgcatgtgttatttgtttgactccttgttattgtccttacggaggattttttttatataagccaaattttgttgtatatattcatattccacgtgacagatggaagcacgtcctatcagtgtgaataaaaagaacagttgtagtaaattattaaagccagtgatttcatggcaggttaccctaccaagctgtgcttgttgatctcccatgaccatactgcttttacaatgtacaaatagttcctaggtgacgagaccctcctttacataatgccgatgacagccttgctgggaactgcggtccttctgctgtgacagccagctcgaaaacaggtcctgcctggagcttgccacacactttagggagacataagagctgtctttccccagcgtcagggacaaagctaccataaagaagtggaaaagtcttggctctccagcctgggacagaggtctctctggaaccccaaggaagagcagaaatgatccttgcctgccactgcacacaatgtgatggtggaaaatccatcaaggaataattgtgagataatgaccgacagttcaggcgcaaagggaattcatgctgtgtaaagtgggtggaattcgtttgcaagctatgcaaagcctgatcttactcaccaggaggatggaaagggtttttttagttatctgagctcagctgagttatcacgcttggagaaccgatttaaaggaattagaatatgatttctgaatacacataacattaaactcttctctttttctatggtaatttagttatggacgttcagcgtctctgagttattgttataaaagacttgtcatcaccgcactgtgctgtaggagactgggctgaacctgtacaatggtataccctggaagttgcttttttaaaaaaaaataataataaacacctaaaatcaaaaaaaaaaaaaaaaa

SEQ ID NO: 187 - protein, 564 aa, Homo sapiens
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSDGSILAIALLILFLLLALALLWWFWPLCCTVIIKEVPPPPAEESEEEDDDGLPKKKWPTVDASYYGGRGVGGIKRMEVRWGEKGSTEEGAKLEKAKNARVKMPEQEYEFPEPRNLNNNMRRPSSPRKWYSPIKGKLDALWVLLRKGYDRVSVMRPQPGDTGRCINFTRVKNNQPAKYPLNNAYHTSSPPPAPIYTPPPPAPHCPPPPPSAPTPPIPSPPSTLPPPPQAPPPNRAPPPSRPPPRPSV

SEQ ID NO: 188 - protein, 1331 aa, Homo sapiens
MRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSLQEAQLCCEGALELHTHHLIPSLRQVVFQGDRLPFQCSASYLGNDTRIRWYHNRAPVEGDEQAGILLAESLIHDCTFITSELTLSHIGVWASGEWECTVSMAQGNASKKVEIVVLETSASYCPAERVANNRGDFRWPRTLAGITAYQSCLQYPFTSVPLGGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVDMASNLMLVDEHLLWLAQREDKACSRIVGALERIGGAALSPHAQHISVNARNVALEAYLIKPHSYVGLTCTAFQRREGGVPGTRPGSPGQNPPPEPEPPADQQLRFRCTTGRPNVSLSSFHIKNSVALASIQLPPSLFSSLPAALAPPVPPDCTLQLLVFRNGRLFHSHSNTSRPGAAGPGKRRGVATPVIFAGTSGCGVGNLTEPVAVSLRHWAEGAEPVAAWWSQEGPGEAGGWTSEGCQLRSSQPNVSALHCQHLGNVAVLMELSAFPREVGGAGAGLHPVVYPCTALLLLCLFATIITYILNHSSIRVSRKGWHMLLNLCFHIAMTSAVFAGGITLTNYQMVCQAVGITLHYSSLSTLLWMGVKARVLHKELTWRAPPPQEGDPALPTPSPMLRFYLIAGGIPLIICGITAAVNIHNYRDHSPYCWLVWRPSLGAFYIPVALILLITWIYFLCAGLRLRGPLAQNPKAGNSRASLEAGEELRGSTRLRGSGPLLSDSGSLLATGSARVGTPGPPEDGDSLYSPGVQLGALVTTHFLYLAMWACGALAVSQRWLPRVVCSCLYGVAASALGLFVFTHHCARRRDVRASWRACCPPASPAAPHAPPRALPAAAEDGSPVFGEGPPSLKSSPSGSSGHPLALGPCKLTNLQLAQSQVCEAGAAAGGEGEPEPAGTRGNLAHRHPNNVHHGRRAHKSRAKGHRAGEACGKNRLKALRGGAAGALELLSSESGSLHNSPTDSYLGSSRNSPGAGLQLEGEPMLTPSEGSDTSAAPLSEAGRAGQRRSASRDSLKGGGALEKESHRRSYPLNAASLNGAPKGGKYDDVTLMGAEVASGGCMKTGLWKSETTV

SEQ ID NO: 189 - protein, 529 aa, Homo sapiens
MARFPKADLAAAGVMLLCHFFTDQFQFADGKPGDQILDWQYGVTQAFPHTEEEVEVDSHAYSHRWKRNLDFLKAVDTNRASVGQDSPEPRSFTDLLLDDGQDNNTQIEEDTDHNYYISRIYGPSDSASRDLWVNIDQMEKDKVKIHGILSNTHRQAARVNLSFDFPFYGHFLREITVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNRCGPCVSSQIGFNCSWCSKLQRCSSGFDRHRQDWVDSGCPEESKEKMCENTEPVETSSRTTTTIGATTTQFRVLTTTRRAVTSQFPTSLPTEDDTKIALHLKDNGASTDDSAAEKKGGTLHAGLIVGILILVLIVATAILVTVYMYHHPTSAASIFFIERRPSRWPAMKFRRGSGHPAYAEVEPVGEKEGFIVSEQC

SEQ ID NO: 190 - protein, 765 aa, Mus musculus
MLLRLLLAWVAAVPALGQVPWTPEPRAACGPSSCYALFPRRRTFLEAWRACRELGGNLATPRTPEEAQRVDSLVGVGPANGLLWIGLQRQARQCQPQRPLRGFIWTTGDQDTAFTNWAQPATEGPCPAQRCAALEASGEHRWLEGSCTLAVDGYLCQFGFEGACPALPLEVGQAGPAVYTTPFNLVSSEFEWLPFGSVAAVQCQAGRGASLLCVKQPSGGVGWSQTGPLCPGTGCGPDNGGCEHECVEEVDGAVSCRCSEGFRLAADGHSCEDPCAQAPCEQQCEPGGPQGYSCHCRLGFRPAEDDPHRCVDTDECQIAGVCQQMCVNYVGGFECYCSEGHELEADGISCSPAGAMGAQASQDLRDELLDDGEEGEDEEEPWEDFDGTWTEEQGILWLAPTHPPDFGLPYRPNFPQDGEPQRLHLEPTWPPPLSAPRGPYHSSVVSATRPMVISATRPTLPSAHKTSVISATRPPLSPVHPPAMAPATPPAVFSEHQIPKIKANYPDLPFGHKPGITSATHPARSPPYQPPIISTNYPQVFPPHQAPMSPDTHTITYLPPVPPHLDPGDTTSKAHQHPLLPDAPGIRTQAPQLSVSALQPPLPTNSRSSVHETPVPAANQPPAFPSSPLPPQRPTNQTSSISPTHSYSRAPLVPREGVPSPKSVPQLPSVPSTAAPTALAESGLAGQSQRDDRWLLVALLVPTCVFLVVLLALGIVYCTRCGSHAPNKRITDCYRWVTHAGNKSSTEPMPPRGSLTGVQTCRTSV

SEQ ID NO: 191 - protein, 1329 aa, Mus musculus
MPVPPARLLLLPLLPCLLLLAPGTRGAPGCPVPIRGCKCSGERPKGLSGGAHNPARRRVVCGGGDLPEPPDPGLLPNGTITLLLSNNKITGLRNGSFLGLSLLEKLDLRSNVISTVQPGAFLGLGELKRLDLSNNRIGCLTSETFQGLPRLLRLNISGNIYSSLQPGVFDELPALKIVDFGTEFLTCDCRLRWLLPWARNHSLQLSERTLCAYPSALHAHALSSLQESQLRCEGALELHTHYLIPSLRQVVFQGDRLPFQCSASYLGNDTRIHWYHNGAPMESDEQAGIVLAENLIHDCTFITSELTLSHIGVWASGEWECSVSTVQGNTSKKVEIVVLETSASYCPAERVTNNRGDFRWPRTLAGITAYQSCLQYPFTSVPLSGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVDMASNLMLVDEHLLWLAQREDKACSGIVGALERIGGAALSPHAQHISVNSRNVALEAYLIKPHSYVGLTCTAFQRREVGVSGAQPSSVGQDAPVEPEPLADQQLRFRCTTGRPNISLSSFHIKNSVALASIQLPPSLFSTLPAALAPPVPPDCTLQLLVFRNGRLFRSHGNNTSRPGAAGPGKRRGVATPVIFAGTSGCGVGNLTEPVAVSLRHWAEGADPMAAWWNQDGPGGWSSEGCRLRYSQPNVSSLYCQHLGNVAVLMELNAFPREAGGSGAGLHPVVYPCTALLLLCLFSTIITYILNHSSIHVSRKGWHMLLNLCFHMAMTSAVFVGGVTLTNYQMVCQAVGITLHYSSLSSLLWMGVKARVLHKELSWRAPPLEEGEAAPPGPRPMLRFYLIAGGIPLIICGITAAVNIHNYRDHSPYCWLVWRPSLGAFYIPVALILPITWIYFLCAGLHLRSHVAQNPKQGNRISLEPGEELRGSTRLRSSGVLLNDSGSLLATVSAGVGTPAPPEDGDGVYSPGVQLGALMTTHFLYLAMWACGALAVSQRWLPRVVCSCLYGVAASALGLFVFTHHCARRRDVRASWRACCPPASPSASHVPARALPTATEDGSPVLGEGPASLKSSPSGSSGRAPPPPCKLTNLQVAQSQVCEASVAARGDGEPEPTGSRGSLAPRHHNNLHHGRRVHKSRAKGHRAGETGGKSRLKALRAGTSPGAPELLSSESGSLHNSPSDSYPGSSRNSPGDGLPLEGEPMLTPSEGSDTSAAPIAETGRPGQRRSASRDNLKGSGSALERESKRRSYPLNTTSLNGAPKGGKYEDASVTGAEAIAGGSMKTGLWKSETTV

SEQ ID NO: 192 - protein, 500 aa, Mus musculus
MRAQLWLLQLLLLRGAARALSPATPAGHNEGQDSAWTAKRTRQGWSRRPRESPAQVLKPGKTQLSQDLGGGSLAIDTLPDNRTRVVEDNHNYYVSRVYGPGEKQSQDLWVDLAVANRSHVKIHRILSSSHRQASRVVLSFDFPFYGHPLRQITIATGGFIFMGDMLHRMLTATQYVAPLMANFNPGYSDNSTVAYFDNGTVFVVQWDHVYLQDREDRGSFTFQAALHRDGRIVFGYKEIPMAVLDISSAQHPVKAGLSDAFMILNSSPEVPESQRRTIFEYHRVELDSSKITTTSAVEFTPLPTCLQHQSCDTCVSSNLTFNCSWCHVLQRCSSGFDRYRQEWLTYGCAQEAEGKTCEDFQDDSHYSASPDSSFSPFNGDSTTSSSLFIDSLTTEDDTKLNPYAEGDGLPDHSSPKSKGPPVHLGTIVGIVLAVLLVAAIILAGIYISGHPNSNAALFFIERRPHHWPAMKFHNHPNHSTYTEVEPSGHEKEGFVEAEQC

SEQ ID NO: 193 - protein, 530 aa, Mus musculus
MARFRRADLAAAGVMLLCHFLTDRFHFAHGEPGHHTNDWIYEVTNAFPWNEEGVEVDSQAYNHRWKRNVDPFKAVDTNRASMGQASPESKGFTDLLLDDGQDNNTQIEEDTDHNYYISRIYGPADSASRDLWVNIDQMEKDKVKIHGILSNTHRQAARVNLSFDFPFYGHFLNEVTVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNGCGPCVSSQIGFNCSWCSKLQRCSSGFDRHRQDWVDSGCPEEVQSKEKMCEKTEPGETSQTTTTSHTTTMQFRVLTTTRRAVTSQMPTSLPTEDDTKIALHLKDSGASTDDSAAEKKGGTLHAGLIVGILILVLIIAAAILVTVYMYHHPTSAASIFFIERRPSRWPAMKFRRGSGHPAYAEVEPVGEKEGFIVSEQC

SEQ ID NO: 194 - protein, 562 aa, Mus musculus
MDRAGRLGAGLRGLCVAALVLVCAGHGGRREDGGPACYGGFDLYFILDKSGSVLHHWNEIYYFVEQLAHRFISPQLRMSFIVFSTRGTTLMKLTEDREQIRQGLEELQKVLPGGDTYMHEGFERASEQIYYENSQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFAVEDTYLLCPAPILKEVGMKAALQVSMNDGLSFISSSVIITTTHCSDGSILAIALLVLFLLLALALLWWFWPLCCTVIIKEVPPPPVEESEEEDDDGLPKKKWPTVDASYYGGRGVGGIKRMEVRWGEKGSTEEGAKLEKAKNARVKMPEQEYEFPEPRNLNNNMRRPSSPRKWYSPIKGKLDALWVLLRKGYDRVSVMRPQPGDTGRCINFTRVKNSQPAKYPLNNTYHPSSPPPAPIYTPPPPAPHCPPPAPSAPTPPIPSPPSTLPPPPQAPPPNRAPPPSRPPPRPSV

SEQ ID NO: 195 - DNA, 2565 bp, Homo sapiens; identical to SEQ ID NO: 173

SEQ ID NO: 196 - protein, 757 aa, Homo sapiens; identical to SEQ ID NO: 177

SEQ ID NO: 197 - DNA, 2973 bp, Homo sapiens
gccccttgcgcctccttgcccggccgcgcccagcccggcgtcccgagcagcgcaggggaggatccccgcgcagtgacccgggagccaccacagactctgggaggctcggcggctggagcagcaggcagctccccgcagctcccggcgcttccaggcagctctctgagccgtgccagaggcccggcccgccattcccagccccgagccatgatgaagactttgtccagcgggaactgcacgctcagtgtgcccgccaaaaactcataccgcatggtggtgctgggtgcctctcgggtgggcaagagctccatcgtgtctcgcttcctcaatggccgctttgaggaccagtacacacccaccatcgaggacttccaccgtaaggtatacaacatccgcggcgacatgtaccagctcgacatcctggatacctctggcaaccaccccttccccgccatgcgcaggctgtccatcctcacaggggatgtcttcatcctggtgttcagcctggataaccgggagtccttcgatgaggtcaagcgccttcagaagcagatcctggaggtcaagtcctgcctgaagaacaagaccaaggaggcggcggagctgcccatggtcatctgtggcaacaagaacgaccacggcgagctgtgccgccaggtgcccaccaccgaggccgagctgctggtgtcgggcgacgagaactgcgcctacttcgaggtgtcggccaagaagaacaccaacgtggacgagatgttctacgtgctcttcagcatggccaagctgccacacgagatgagccccgccctgcatcgcaagatctccgtgcagtacggtgacgccttccaccccaggcccttctgcatgcgccgcgtcaaggagatggacgcctatggcatggtctcgcccttcgcccgccgccccagcgtcaacagtgacctcaagtacatcaaggccaaggtccttcgggaaggccaggcccgtgagagggacaagtgcaccatccagtgagcgagggatgctggggcggggcttggccagtgccttcagggaggtggccccagatgcccactgtgcgcatctccccaccgaggccccggcagcagtcttgttcacagaccttaggcaccagactggaggcccccgggcgctggcctccgcacattcgtctgccttctcacagctttcctgagtccgcttgtccacagctccttggtggtttcatctcctctgtgggaggacacatctctgcagcctcaagagttaggcagagactcaagttacaccttcctctcctggggttggaagaaatgttgatgccagaggggtgaggattgctgcgtcatatggagcctcctgggacaagcctcaggatgaaaaggacacagaaggccagatgagaaaggtctcctctctcctggcataacacccagcttggtttgggtggcagctgggagaacttctctcccagccctgcaactcttacgctctggttcagctgcctctgcaccccctcccacccccagcacacacacaagttggcccccagctgcgcctgacattgagccagtggactctgtgtctgaagggggcgtggccacacctcctagaccacgcccaccacttagaccacgcccacctcctgaccgcgttcctcagcctcctctcctaggtccctccgcccgacagttgtgctttgttgtggttgcagctgttttcgtgtcatgtatagtagtagaaatggaaatcattgtactgtaaaagcctagtgactccctccttggccaggccctcacccagttcagatccacggcctccacccgggacgccttcctcctctgctcccaaacagggtttccgtggcctgtttgcagctagacattgacctccgccattgagctccacggtttacagacaattgcacaagcgtggggtgggcaggccaggactgcttttttttaatgctcccatttcacagaggataccaccgagactcggaggggacacgatgagcaccaggccccacctttgtcccctagcaaattcagggtacagctccacctagaaccaggctgccctctactgtgctcgttcctcaagcatttattaagcacctactgggtgctgggttcactgtgtcctaggaaaccaagagggtccccagtcctggcctctgcccgcccctgctgccccaccaccttctgcacacacagcggtggggaggcggggaggagcagctgggacccagaactgagcctgggagggatccgacagaaaagctcagggcgggtcttctccttgtgcccgggattgggctatgctgggtaccaccatgtactcaggcatggtgggttttgaacccataaaccaaaggcccttgtcatcagctcttaacaagtatattttgtattttaatctctctaaacatattgaagttttagggccctaaggaaccttagtgatcttctattgggtctttctgaggttcagagagggtaagtaacttcctccaggtcacacagcaagtctgtgggtggcagaagcaagctagcgctgggcattcagtacataccacgatgtgctccctctcttgatgcttggcccctggggccttcagggctttgggacatcttgtcctcaaccctctccctagatcagtctgtgagggtccctgtagatattgtgtacaccatgcccatgtatatacaagtacacacagatgtacacacagatgtacacatgctccagccccagctctgcatacctgcacctgcaccccagccttggcccctgcctgcgtctgtgctcaaagcagcagctccaaccctgcctctgtccccttccccacccactgcctgagccttctgagcagaccaggtaccttggctgcaccggtgtgtggcccgctctcacccaggcacagccccgccaccatggatctccgtgtacactatcaataaaagtgggtttgttaca

SEQ ID NO: 198 - protein, 266 aa, Homo sapiens
MMKTLSSGNCTLSVPAKNSYRMVVLGASRVGKSSIVSRFLNGRFEDQYTPTIEDFHRKVYNIRGDMYQLDILDTSGNHPFPAMRRLSILTGDVFILVFSLDNRESFDEVKRLQKQILEVKSCLKNKTKEAAELPMVICGNKNDHGELCRQVPTTEAELLVSGDENCAYFEVSAKKNTNVDEMFYVLFSMAKLPHEMSPALHRKISVQYGDAFHPRPFCMRRVKEMDAYGMVSPFARRPSVNSDLKYIKAKVLREGQARERDKCTIQ

SEQ ID NO: 199 - DNA, 2159 bp, Homo sapiens
ggcggcggcatggcgaggttcccgaaggccgacctggccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgaggaggatacagaccacaattactatatatctcgaatatatggtccatctgattctgccagccgggatttatgggtgaacatagaccaaatggaaaaagataaagtgaagattcatggaatattgtccaatactcatcggcaagctgcaagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccataggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcgttggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgagggatcgacacctttggttcaaatgttctctgatgtctcaaagataactgttttccaaagcctgaaccctttcactcaaaagagcaatgatgaatgtctcaagattgctaagaaaaacagcccatgcaagagtgagaacaaacacaaaataagagattttctacattttcaaaaaaaaaaaaaaaaaaaaaaaaaa

SEQ ID NO: 200 - protein, 529 aa, Homo sapiens; identical to SEQ ID NO: 189

SEQ ID NO: 201 - DNA, 2608 bp, Homo sapiens
gaggtaggggctgagagaggcttgaggtggaagtgggggtcgggcactctgacctggtcgaggaggggctagggtttgaaccggggacagagtctaggtgagctggggctgggagctattagcgtagaggatccgggttcggttgctctggcgagggctccagcatcacaggcggcggctgcgggcgcagagcggaaatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgggggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 202 - protein, 350 aa, Homo sapiens
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLPVEGELCHDPASRLLDLITWELEPDGALDRCPCASGLLCQPHSHSLVYVCKPTFVGSRDQDGEILLPREVPDEYEVGSFMEEVRQELEDLERSLTEEMALGEPAAAAAALLGGEEI

SEQ ID NO: 203 - DNA, 7540 bp, Homo sapiens
gtgagttacgccactatggcggacggggcaccccggccccagctttaccgcagcgtctcgttcaagctgctggagcgctggagcggcggccccgggctgagggaggaggacacggacacccccggcttgaggcgacgcgcctcgtgccggccgaccacggctgcccggggccagccctctcggcgcgtgtccaagctggcgtctgggcccctggccgcccccgcgcagccgcgcccgctccgcagcctctcgccgtcggttcgccagctctcccggcgcttcgacgcgccgcgtctggacgacggctccgctgggacccgagacggaggcgtcttacccgcggccgcggaagaagcggccgagggcccagcgcgaggagcctggcccagcgtcaccgagatgcgcaagctcttcggcggtcctggctccaggaggcccagcgccgactctgaatccccaggaacgcccagccccgacggtgccgcgtgggagcctccggctcgggagtcgcggcagccaccgacgccaccccctcggacatgcttccccctggcgggtctgcgttcggcgcggcccctgaccgggccggagaccgaagggaggctgcgccggccgcagcagcaacaggagcgggcgcagcgtccagcggatggtttacattcttggcatatcttctcccaaccgcaggccggggcccgggcctcctgctcctcctcctccatcgccgcctcctatcctgtcagccgcagtcgtgctgccagctccagcgaggaggaagaggagggcccgccgcagctgcctggagcccagagtccggcctaccacggcggccactcctcgggcagtgacgacgaccgagacggtgagggcggccaccgctggggagggaggcccgggctcaggcctggaagctccctattggatcaggactgcaggcctgacagtgatgggttaaatctaagcagcatgaactcagcaggggtttctgggagccctgagcccccaacatctccaagagcccctagagaagaaggactccgggagtggggtagtggctctccgccctgcgtcccaggtccccaggagggacttcggcctatgtctgactctgtgggaggagctttccgtgtggccaaggtgagctttccctcgtacctggccagccccgcaggctcccgcggtagcagccgttattccagcacggagaccctcaaggacgacgacctatggtctagtaggggttctgggggctggggcgtgtaccgctcccctagctttggagctggggaagggctcctgcggtcccaggctcgaacccgtgccaaaggacctggaggcacctctagggcattgagggatggaggatttgagcctgaaaagagtcgacagcggaagtccctgtcaaatccagatatcgcctcagagaccctgacgcttctcagtttcctgcgctcagacctttcagagctgagggtccgaaaacctggtgggagctccggggaccgtggaagcaaccccctagatggcagagactcaccatccgcaggtggccctgtggggcaacttgaacccatacccatcccagccccagcatcacctggcacgcgccccacactcaaggacttgacagccactctgcggagagcaaagtcattcacctgctctgagaagcccatggcccgccgcctgccccgcaccagtgctctgaagtccagctcctccgagctcctgctcacaggccctggtgccgaggaggatccgctgcccctcatcgtccaggaccaatatgtgcaggaggcccgccaggtttttgagaagatccagcgcatgggtgcccaacaagatgatggaagcgatgccccccctggaagccctgactgggcaggggatgtgacccgagggcagcggtcccaggaggagctctcaggccctgagtccagtctgacagatgaaggcattggggcagaccctgagcctcctgttgcagcattttgcggcctgggtaccacagggatgtggcgacctctttcctcatcctcggcccagacgaaccaccatggccctgggactgaggacagtctgggcgggtgggccctggtgtcgcctgagacccctcccacaccaggtgccctccgccgacgacgcaaagtcccaccttcaggttctggtgggagcgaattgagcaatggggaggcaggggaggcctacaggtccctgagtgacccaattcctcagcgccaccgggctgccacctctgaagagcctactgggttctctgtggacagcaacctcctgggctcactgagccccaagacagggctccctgccacctcagccatggatgagggcttgaccagtggtcacagtgactggtctgtgggcagtgaagagagcaagggatatcaggaggttattcagagcatagttcaggggcctggcaccctggggcgtgtggtggacgacaggattgctggcaaagcccccaagaagaaatccctgagtgaccccagccgccgtggggagctggctgggcctggattcgagggccctggaggggagcccatccgagaagttgagcccatgctgcctccatccagcagcgagcccatccttgtagagcagcgggcagagccagaagaacctggtgccaccaggagccgggcacagtctgaaagggccctacctgaggctctgcctccccctgccactgcccaccgaaactttcaccttgaccccaagctggctgacattctgtccccgaggctaatccgccgaggctccaagaagcgcccagctcggagtagtcaccaggagcttcggagagacgagggcagtcaggaccagactggcagcctgtctcgggcccggccctcctccagacacgttcgccatgccagtgtgcccgccacatttatgcctattgtggtgcctgagccaccaacttctgttggtccccctgtggctgtgccagaacccataggcttccctacccgagcccatcccacgttgcaggcaccatcgctcgaggacgtcaccaagcagtacatgctgaacctgcactccggtgaggtccctgccccagtgccagtggacatgccctgcttgcctctggctgcaccgccctctgctgaggccaagccccctgaggcagctcggcctgcagatgagcctacccctgccagcaagtgctgcagcaagccacaggtggacatgcggaagcacgtggccatgaccctgctggacacagagcagtcgtatgtggagtcgctgcgcaccctgatgcagggctacatgcagccgctgaagcagccagagaactccgtgctctgtgacccttcactggtggacgagatcttcgaccagatccccgagctcctggagcaccacgagcaattcctggagcaggttcggcactgcatgcagacctggcatgcccagcagaaggtgggagccctgctcgtccagtcgttctccaaggatgtcctagtaaacatctattctgcctatatcgataacttcctcaatgcaaaggatgctgtgcgtgtggccaaggaggcgaggcctgcctttctcaagttcctagagcaaagcatgcgtgagaacaaggagaagcaggcgctgtctgacctcatgatcaagcctgtgcagcggatcccacgctacgagcttctggtgaaggacctcctgaagcatacacctgaggaccacccggaccatccactcctgctggaggcgcagcggaacatcaagcaggtggctgagcgcatcaacaagggtgtgcggagtgccgaggaggcggagcgccatgcccgtgtgctgcaggagatagaggctcacatcgagggcatggaggatctccaggcccctctgcggcggttcctgagacaggagatggtcattgaagtgaaggcgatcggtggcaagaaggaccggtctctcttcctgttcacggacctcatcgtctgcaccactctgaagcgaaagtcaggctccctgcggcgcagctccatgagcctgtacacggcagccagtgtcattgacacagccagcaagtacaagatgctgtggaagctgccgctggaagacgcagacatcatcaaaggggcatcccaagccaccaatcgggagaacatccagaaggccatcagccgccttgatgaggacctcaccaccctgggccaaatgagcaagctctctgagagccttggtttcccccaccagagcctggacgatgcactgcgggacctctcagctgccatgcaccgggacctgtcggagaagcaggcgctgtgctacgcgctttccttcccgccaaccaagctggagctgtgcgccactcggcccgagggcaccgactcctacatttttgagttccctcaccctgacgcccgccttggttttgaacaggccttcgatgaggccaagaggaagctggcatccagcaaaagctgtctagaccctgagttcctgaaggccatccccatcatgaaaacccgcagtggcatgcagttctcctgtgcggctcccaccctgaacagctgcccggagccctcgcctgaggtatgggtctgcaacagcgacggctacgtgggccaggtgtgcctgctgagcctgcgcgccgagccggacgtggaggcctgcatcgccgtctgttccgcccgcatcctctgcatcggggcggtgcccgggctgcagcctcgctgccaccgggagcctcctccgtcgctgaggagtcctccagagacggcaccggagcccgccgggccggagctggacgtcgaggccgctgcagacgaggaagccgcgacgctcgcggagccggggccgcagccctgccttcacatctccattgcaggctcgggcttggagatgacgccgggcctcggcgagggtgacccccgcccagagctggtgccctttgacagtgactctgacgatgagtcttcgcccagcccctcggggacgctgcagagccaggccagccggtccaccatctcctccagctttggcaatgaggagaccccgagttccaaggaggccacggcagagaccaccagctcagaggaggagcaggagccaggcttcctgccactgtctggctcctttgggcctggtggtccctgcggcaccagcccaatggatgggagagcccttcgccgctccagccacggctccttcacccggggcagccttgaggacctgctgagtgtcgaccctgaggcctaccagagctccgtgtggctgggcactgaggatggctgtgtccacgtgtaccagtcctccgacagcatccgtgaccgcaggaacagcatgaagctccagcatgcggcctctgtgacctgcatcttgtatctgaataaccaggtgtttgtgtctctggccaatggagagcttgtggtctaccaaagggaagcaggccatttctgggacccccagaacttcaaatcagtgaccttgggcacccaggggagccccatcaccaagatggtatctgtgggtgggcggctgtggtgtggctgccagaaccgagtccttgtcctgagccctgacacgctgcagctggagcacatgttttacgtgggtcaggattcaagccgctgcgtggcttgcatggtggactccagcctgggtgtgtgggtgacattgaaaggtagtgcccacgtgtgtctctaccatccagacacctttgagcagctggcagaagtagacgtcactcctcccgtgcacaggatgctggcaggctcggatgccatcatccggcagcacaaggctgcctgtctgcgaatcacagcgctgctggtgtgtgaggagctgctgtgggtgggcaccagtgctggtgtcgtcctcaccatgcccacttcgcccggtactgtcagctgcccacgggcaccactcagtcccacaggcctcggccagggacacaccggccacgtccgcttcttggctgcagtccagctgccagatggcttcaacctgctctgcccaaccccaccacctcccccagacacaggccccgagaagctgccatcactggagcaccgggactccccttggcaccgaggccccgcccctgccaggcctaaaatgctggttatcagtggaggtgatggctatgaggacttccgactcagcagtgggggcggcagcagcagtgagactgtgggtcgagacgacagcacaaaccacctcctcctgtggagggtgtgaccctgtctgccgtggcccaggactcgcccgcccacctgccttcagcctgcttgcctctccctagcccacacgcagactttgaccaggagtatccagccaggggcacacatgtgcctgcgtgggctctgccttgtcttcgcggaagcattcctgatggaacacccactggccagccaggccatggcttctcccgaccctctggctgccccggtgcttccagtcatgatcgggtgggggacatgtgggctgaccaggacctctgaccctgggagcttctaccaaagacacagctgggtctggaccccacggggctggggagggccatgtgcaatatttggagggttttctggagggcagcaggaaggctggggaattccccatgtacagtatttatgtttctttttagatgtgtaccttcccaagcacttatttatgcagtgacctggtcacctggggtgggggtgatttgaggaaatgacatgaggaaaagaaacctattcctgccctggggaccaccctgggactctaaccaagccttcctggagggacccatgcgcccctgagccccattccattcatacagacacacacgtacgcacactgcatgtccaaggccctaaacattgcccgttgacataaactttccagggccccagcctgatggggctgccctcagtcctctagatcaagatgctgactattagggggcagtgattgccatctggggacctgtcaggctttgtcatttcccagtttgttggtggtgcctttagtggttccctaatttgggaacactgatggggccttggacagggctttctctcaggtaggagaaatgggcccatgatctcctcacagtcgcccccagtccttggccctgcttccctgtgtctcatgcactggcacatatggtcaccttggagggcagacctaggagcccctctgaccactgaatccgtctccacaccccttctgccaagggaagccccttcaggaaggaccccccaaagctgaggggctgaatgtagccttttcaacagagaaggctcccacttgagagcagcctctacctgaccccctggaccacagagagccactctgaccctcagccccctcgcttcttcagctaaaactccaaaggtttggtttcagatggggtttgttttgttctgtttggttttggttttgtttggggtgggtgggtcattgcggtcttagattatgtttctcttgctaccaaacagtcatgtattaactctctttggatgatgaagtttaaagagtcaataaatagaaacaccagatgactgcaaaaaaaaaaaaaaaaaaaaaa

SEQ ID NO: 204 - protein, 2063 aa, Homo sapiens
MADGAPRPQLYRSVSFKLLERWSGGPGLREEDTDTPGLRRRASCRPTTAARGQPSRRVSKLASGPLAAPAQPRPLRSLSPSVRQLSRRFDAPRLDDGSAGTRDGGVLPAAAEEAAEGPARGAWPSVTEMRKLFGGPGSRRPSADSESPGTPSPDGAAWEPPARESRQPPTPPPRTCFPLAGLRSARPLTGPETEGRLRRPQQQQERAQRPADGLHSWHIFSQPQAGARASCSSSSIAASYPVSRSRAASSSEEEEEGPPQLPGAQSPAYHGGHSSGSDDDRDGEGGHRWGGRPGLRPGSSLLDQDCRPDSDGLNLSSMNSAGVSGSPEPPTSPRAPREEGLREWGSGSPPCVPGPQEGLRPMSDSVGGAFRVAKVSFPSYLASPAGSRGSSRYSSTETLKDDDLWSSRGSGGWGVYRSPSFGAGEGLLRSQARTRAKGPGGTSRALRDGGFEPEKSRQRKSLSNPDIASETLTLLSFLRSDLSELRVRKPGGSSGDRGSNPLDGRDSPSAGGPVGQLEPIPIPAPASPGTRPTLKDLTATLRRAKSFTCSEKPMARRLPRTSALKSSSSELLLTGPGAEEDPLPLIVQDQYVQEARQVFEKIQRMGAQQDDGSDAPPGSPDWAGDVTRGQRSQEELSGPESSLTDEGIGADPEPPVAAFCGLGTTGMWRPLSSSSAQTNHHGPGTEDSLGGWALVSPETPPTPGALRRRRKVPPSGSGGSELSNGEAGEAYRSLSDPIPQRHRAATSEEPTGFSVDSNLLGSLSPKTGLPATSAMDEGLTSGHSDWSVGSEESKGYQEVIQSIVQGPGTLGRVVDDRIAGKAPKKKSLSDPSRRGELAGPGFEGPGGEPIREVEPMLPPSSSEPILVEQRAEPEEPGATRSRAQSERALPEALPPPATAHRNFHLDPKLADILSPRLIRRGSKKRPARSSHQELRRDEGSQDQTGSLSRARPSSRHVRHASVPATFMPIVVPEPPTSVGPPVAVPEPIGFPTRAHPTLQAPSLEDVTKQYMLNLHSGEVPAPVPVDMPCLPLAAPPSAEAKPPEAARPADEPTPASKCCSKPQVDMRKHVAMTLLDTEQSYVESLRTLMQGYMQPLKQPENSVLCDPSLVDEIFDQIPELLEHHEQFLEQVRHCMQTWHAQQKVGALLVQSFSKDVLVNIYSAYIDNFLNAKDAVRVAKEARPAFLKFLEQSMRENKEKQALSDLMIKPVQRIPRYELLVKDLLKHTPEDHPDHPLLLEAQRNIKQVAERINKGVRSAEEAERHARVLQEIEAHIEGMEDLQAPLRRFLRQEMVIEVKAIGGKKDRSLFLFTDLIVCTTLKRKSGSLRRSSMSLYTAASVIDTASKYKMLWKLPLEDADIIKGASQATNRENIQKAISRLDEDLTTLGQMSKLSESLGFPHQSLDDALRDLSAAMHRDLSEKQALCYALSFPPTKLELCATRPEGTDSYIFEFPHPDARLGFEQAFDEAKRKLASSKSCLDPEFLKAIPIMKTRSGMQFSCAAPTLNSCPEPSPEVWVCNSDGYVGQVCLLSLRAEPDVEACIAVCSARILCIGAVPGLQPRCHREPPPSLRSPPETAPEPAGPELDVEAAADEEAATLAEPGPQPCLHISIAGSGLEMTPGLGEGDPRPELVPFDSDSDDESSPSPSGTLQSQASRSTISSSFGNEETPSSKEATAETTSSEEEQEPGFLPLSGSFGPGGPCGTSPMDGRALRRSSHGSFTRGSLEDLLSVDPEAYQSSVWLGTEDGCVHVYQSSDSIRDRRNSMKLQHAASVTCILYLNNQVFVSLANGELVVYQREAGHFWDPQNFKSVTLGTQGSPITKMVSVGGRLWCGCQNRVLVLSPDTLQLEHMFYVGQDSSRCVACMVDSSLGVWVTLKGSAHVCLYHPDTFEQLAEVDVTPPVHRMLAGSDAIIRQHKAACLRITALLVCEELLWVGTSAGVVLTMPTSPGTVSCPRAPLSPTGLGQGHTGHVRFLAAVQLPDGFNLLCPTPPPPPDTGPEKLPSLEHRDSPWHRGPAPARPKMLVISGGDGYEDFRLSSGGGSSSETVGRDDSTNHLLLWRV

SEQ ID NO: 205 - DNA, 2247 bp, Homo sapiens
ccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctgcagggggatggggtggggtacaaccaccatgacaactgccgggagggccacgcaggtcgtggtcacctgccagcgactgtctcagactgggcagggaggctttggcatgacttaagaggaagggcagtcttgggacccgctatgcaggtcctggcaaacctggctgccctgtctcatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttct

SEQ ID NO: 206 - protein, 488 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSPVPRRATDWRGVPSEIDAAFQDADGYAYFLRGRLYWKFDPVKVKALEGFPRLVGPDFFGCAEPANTFL

SEQ ID NO: 207 - DNA, 3074 bp, Homo sapiens
ggcacgaggctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgacgcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggctttcccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatcctttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtgaaaaaaaaaaaaaaaaaaaaa

SEQ ID NO: 208 - protein, 660 aa, Homo sapiens
MEALMARGALTGPLRALCLLGCLLSHAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 209 - DNA, 4160 bp, Homo sapiens
ggggcggggccggggcggggcctgacttcccgactgggagccttagccgcggggctgagaccaggcagcctgcgttcgccatgaagcgacccaaggagccgagcggctccgacggggagtccgacggacccatcgacgtgggccaagagggccagctgagccagatggccaggccgctgtccacccccagctcttcgcagatgcaagccaggaagaaacgcagagggatcatagagaaacggcgtcgagaccgcatcaacagtagcctttctgaattgcgacgcttggtccccactgcctttgagaaacagggctcttccaagctggagaaagccgaggtcttgcagatgacggtggatcacttgaaaatgctccatgccactggtgggacaggattctttgatgcccgagccctggcagttgacttccggagcattggttttcgggagtgcctcactgaggtcatcaggtacctgggggtccttgaagggcccagcagccgtgcagaccccgtccggattcgccttctctcccacctcaacagctacgcagccgagatggagccttcgcccacgcccactggccctttggccttccctgcctggccctggtctttcttccatagctgtccagggctgccagccctgagcaaccagctcgccatcctgggaagagtgcccagccctgtcctccccggtgtctcctctcctgcttaccccatcccagccctccgaaccgctccccttcgcagagccacaggcatcatcctgccagcccggaggaatgtgctgcccagtcgaggggcatcttccacccggagggcccgccccctagagaggccagcgacccctgtgcctgtcgcccccagcagcagggctgccaggagcagccacatcgctcccctcctgcagtcttcctccccaacaccccctggtcctacagggtcggctgcttacgtggctgttcccacccccaactcatcctccccagggccagctgggaggccagcgggagccatgctctaccactcctgggtctctgaaatcactgaaatcggggctttctgagctgccccttcaccaccccgccccaaggaataaggaaggttcttttaccaggagcccaaaaaagggcactgccttttctgctttgcttcgtggactggctcatatgtgaaggcacgttctccagccatcagaggccccctcctcctccaacccatctctccttctcactgttatcccagcttatccacccagctctcctggagctgttctggtctcagaggcttggttccatttctcacctgaacagatgagtcctgggagagaccctcagagatccgcccagacccctctcctgccctctgcacaccagcagcaggcatgaaccttgggtctgggaaaaagctttaacctgcagggcaccaggacccaaggcaggctgttccttggggcggtcagaccccagtcaggagcaatgactgactggctgcagccttcccacgccaagaggctggaacatagtgtctgcctcgcttcctggagatagtaactgagcaggggctacaaagaggtctcctgggaaccctgtctgccccttcccacctgtccttgggccacaccatcacactgaaccacaggacagaccctttctccaccacagccaaggcctggagactgggggcccagcagagcctgctcccaccctcctcccagcagcagacacccaccctctcactgactaacaggtccctgcacacagctggcctggtaaacccagctgggaggtttctaggcagcagcaaaactctgtgacagggtgtcctcacaccaggccttggacagctctcccagacaggagccagggttgagcaatggagagcccagcccccacgtcttacagtcgccatcctccaggcgtgtggtccctccccattgggtgcacagtgcagaggggccgtggccccatgtgatggtgcgcagagaggaacctcttgggattcagcaccagacgtctgtgctgcctggtttgcatccggctcacagagcccagactgctggaacagccaaggactgtcaggctggacaaaaataactgcaaggaggggcaagagaaaggatgattcgaggcaccttggcccttcaaggtcatgcagtgggtcgagcgcctgagatcctgttcaccaggactccacagagctggctctgctcagaagccatttcattccccggctccaccctaggccactttttctaacagaggaaacaaatggtccagcagtcgttcccagcagaacagcggagcctggactgacacccagtgggaccagtgttgccacaccagttgataaaatgcagaaacccttctgtactcgttggtaaatatctactcccccaagtgactccaggtgccccccaccgcctggcacttcccccaggactcctacgatctggttactgcctggccgatccaaggctgtggagtcccagagccagcagttcactggtgctcattccacactggttagatacttcagttgtcacccctgggaagattctcccacctcctccctttgatggaaccaccctccccagaggctgcattgaggagactccacagactgaaaagtgagtttgcagaaaccttggggaaaagggccctttcaaagaagtggataagagggaggagatcattgagtgacccagaaagctcttttgaaaagacagactcctcaaggagagataaagaggaaagcacctctttcattttttagtgtgagctaattccatcagactgctgtcctcctggacccatctgagatgtgcagtagcaaggagaggggggatcattttagagagtgggtcattggcagggagtgctccggagggaggcagaggggagactgtggtagaaggaagacagaactcacacatgctcccaggattggggacagggacagaggaggtaacagaaggcaaaggccagtttccccgttatcatgaaggggcccactcaggacaggaacaaggacaactcctcctcctcctcctcctctcctgctgctcctgggataccaggtcagtgatgtagtcttgcagtttggcaacttcctagcctgagaatccctagtggggctgtgggaaacacatttccacgttgcaagcatgcaactccaaagaatctgtgatgccactgaaatgagatgggaatgatccagctctttcagcatcttggttgaacttgctttcattgtccctgggatattgtggaaggaaaggtgactgtgtgatctgattctgtggtcaaggacttgcatcttgtgtttctatccccaagccttcctggtgtctccaactcctaccccattgcatgggttgttgcggacatccaataaagatttttttagtgcttctggaaacttccagtagattctacttctaaactatctctggagtccatccacttctgtctgcacccacagccatcctggccaggccacatcacctcccccagatcactgccctggcctcagaaaggtcttccctcttgctttgtcaatcagttctcagtagcagcagagagaaattgaaagctgcaggtcatatcgtatcatctttagtttgaaaacctcactctcttaccctattgttctaaaggtcttcttttggtcccaacctcacttccagcctcatttcttgccagtcccagacttgctccctgagcttctgccacctgcccttccttcatttcctcgacattccagccttgttcccacctccagcactttgcatatgctgttccctttgccaagaatgctcttcccctaccctgtgcatggctgagttctgcagaccctcaggccttggcttcaacgttgcctcgtccaagaggccttcctcgactactttacttgtggagttcctctatcacaaggcctctgttctttcccttcatggagaatttgccactgcatatccatttgtgtaatttacttgttggttgactgtgcctcccactcgagtgtaagctcatgaggccaggtgccatgcctggttcagtctccactctgtacccagcattgagcacagggcctggtccatagttggcgttcaataaatacttgttgaagaagtgaaaaaaaaaaaaaaaaaaaaaaa

SEQ ID NO: 210 - protein, 328 aa, Homo sapiens
MKRPKEPSGSDGESDGPIDVGQEGQLSQMARPLSTPSSSQMQARKKRRGIIEKRRRDRINSSLSELRRLVPTAFEKQGSSKLEKAEVLQMTVDHLKMLHATGGTGFFDARALAVDFRSIGFRECLTEVIRYLGVLEGPSSRADPVRIRLLSHLNSYAAEMEPSPTPTGPLAFPAWPWSFFHSCPGLPALSNQLAILGRVPSPVLPGVSSPAYPIPALRTAPLRRATGIILPARRNVLPSRGASSTRRARPLERPATPVPVAPSSRAARSSHIAPLLQSSSPTPPGPTGSAAYVAVPTPNSSSPGPAGRPAGAMLYHSWVSEITEIGAF

SEQ ID NO: 211 - DNA, 5680 bp, Homo sapiens; identical to SEQ ID NO: 180

SEQ ID NO: 212 - protein, 1331 aa, Homo sapiens; identical to SEQ ID NO: 188

SEQ ID NO: 213 - DNA, 5086 bp, Homo sapiens
  misc_feature (1)...(5086): n = A,T,C or G
agcaccacggcagcaggaggtttcggnctaagttggaggtactggnccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtgggcttcctggtgagagaggacgtgttggtgcccctggcccagctggtgcccgtggcagtgatggaagtgtgggtcccgtgggtcctgctggtcccattgggtctgctggccctccaggcttcccaggtgcccctggccccaagggtgaaattggagctgttggtaacgctggtcctgctggtcccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctgttggtgctgccggtgctactggtgccagaggacttgttggtgagcctggtccagctggctccaaaggagagagcggtaacaagggtgagcccggctctgctgggccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggcccagctggagcaagaggagagcctggcaacattggattccctggacccaaaggccccactggtgatcctggcaaaaacggtgataaaggtcatgctggtcttgctggtgctcggggtgctccaggtcctgatggaaacaatggtgctcagggacctcctggaccacagggtgttcaaggtggaaaaggtgaacagggtcccgctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcatggtgctgtaggtgcccctggtcctgctggagccacaggtgaccggggcgaagctggggctgctggtcctgctggtcctgctggtcctcggggaagccctggtgaacgtggcgaggtcggtcctgctggccccaacggatttgctggtccggctggtgctgctggtcaaccgggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctacctggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttaaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacggttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccatgaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 214 - protein, 1366 aa, Homo sapiens
MLSFVDTRTLLLLAVTLCLATCQSLQEETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPIGSAGPPGFPGAPGPKGEIGAVGNAGPAGPAGPRGEVGLPGLSGPVGPPGNPGANGLTGAKGAAGLPGVAGAPGLPGPRGIPGPVGAAGATGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPAGARGEPGNIGFPGPKGPTGDPGKNGDKGHAGLAGARGAPGPDGNNGAQGPPGPQGVQGGKGEQGPAGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAHGAVGAPGPAGATGDRGEAGAAGPAGPAGPRGSPGERGEVGPAGPNGFAGPAGAAGQPGAKGERGAKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGLKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMDAIKVYCDFSTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADHEFFVDIGPVCFK

SEQ ID NO: 215 - DNA, 4898 bp, Homo sapiens
gaattccggctgccaggggcgtccggttacatccccgccttcctctgtcctggccgcgggaccgggtttgcgggaccgcagttcgggaacatgttggcctcgagcagccggatccgggctgcgtggacgcgggcgctgctgctgccgctgctgctggcggggcctgtgggctgcctgagccgccaggagctctttcccttcggccccggacagggggacctggagctggaggacggggatgacttcgtctctcctgccctggagctgagtggggcgctccgcttctacgacagatccgacatcgacgcagtctacgtcaccacaaatggcatcattgctacgagtgaacccccggccaaagaatcccatcccgggctcttcccaccaacattcggtgcagtcgcccctttcctggcggacttggacacgaccgatggcctggggaaggtttattatcgagaagacttatccccctccatcactcagcgagcagcagagtgtgtccacagagggttcccggagatctctttccagcctagtagcgcggtggttgtcacttgggaatccgtggccccctaccaagggcccagcagggacccagaccagaaaggcaagagaaacacgttccaggctgttctagcctcctctgattccagctcctatgccattttcctttatcctgaggatggtctgcagttccatacgacattctcaaagaaggaaaacaaccaagttcctgccgtggttgcattcagtcaaggttcagtgggattcttatggaagagcaacggagcttataacatatttgctaatgacagggaatcaattgaaaatttggccaagagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttgttttcagctataacacggattcccgccagacgtgtgctaacaacagacaccagtgctcggtgcacgcagagtgcagggactacgccacgggcttctgctgcagctgtgtcgctggctatacgggcaatggcaggcaatgtgttgcagaaggttccccccagcgagtcaatggcaaggtgaaaggaaggatctttgtggggagcagccaggtccccattgtctttgagaacactgacctccactcttacgtagtaatgaaccacgggcgctcctacacagccatcagcaccattcccgagaccgttggatattctctgcttccactggccccagttggaggcatcattggatggatgtttgcagtggagcaggacggattcaagaatgggttcagcatcaccgggggtgagttcactcgccaggctgaggtgaccttcgtggggcacccgggcaatctggtcattaagcagcggttcagcggcatcgatgagcatgggcacctgaccatcgacacggagctggagggccgcgtgccgcagattccgttcggctcctccgtgcacattgagccctacacggagctgtaccactactccacctcagtgatcacttcctcctccacccgggagtacacggtgactgagcccgagcgagatggggcatctccttcacgcatctacacttaccagtggcgccagaccatcaccttccaggaatgcgtccacgatgactcccggccagccctgcccagcacccagcagctctcggtggacagcgtgttcgtcctgtacaaccaggaggagaagatcttgcgctacgctttcagcaactccattgggcctgtgagggaaggctcccctgatgctcttcagaatccctgctacatcggcactcatgggtgtgacaccaacgcggcctgtcgccctggtcccaggacacagttcacctgcgagtgctccatcggcttccgaggagacgggcgaacctgctatgatattgatgaatgttcagaacaaccctcagtgtgtgggagccacacaatctgcaataatcacccaggaaccttccgctgcgagtgtgtggagggctaccagttttcagatgagggaacgtgtgtggctgtcgtggaccagcgccccatcaactactgtgaaactggccttcataactgcgacataccccagcgggcccagtgtatctacacaggaggctcctcctacacctgttcctgcttgccaggcttttctggggatggccaagcctgccaagatgtagatgaatgccagccaagccgatgtcaccctgacgccttctgctacaacactccaggctctttcacgtgccagtgcaaacctggttatcagggagacggcttccgttgcgtgcccggagaggtggagaaaacccggtgccagcacgagcgagaacacattctcggggcagcgggggcgacagacccacagcgacccattcctccggggctgttcgttcctgagtgcgatgcgcacgggcactacgcgcccacccagtgccacggcagcaccggctactgctggtgcgtggatcgcgacggccgcgaggtggagggcaccaggaccaggcccgggatgacgcccccgtgtctgagtacagtggctcccccgattcaccaaggacctgcggtgcctaccgccgtgatccccttgcctcctgggacccatttactctttgcccagactgggaagattgagcgcctgcccctggagggaaataccatgaggaagacagaagcaaaggcgttccttcatgtcccggctaaagtcatcattggactggcctttgactgcgtggacaagatggtttactggacggacatcactgagccttccattgggagagctagtctacatggtggagagccaaccaccatcattagacaagatcttggaagtccagaaggtatcgctgttgatcaccttggccgcaacatcttctggacagactctaacctggatcgaatagaagtggcgaagctggacggcacgcagcgccgggtgctctttgagactgacctggtgaatcccagaggcattgtaacggattccgtgagagggaacctttactggacagactggaacagagataaccccaagattgaaacttcctacatggacggcacgaaccggaggatccttgtgcaggatgacctgggcttgcccaatggactgcacttcgatgcgttctcatctcagctctgctgggtggatgcaggcaccaatcgggcggaatgcctgaaccccagtcagcccagcagacgcaaggctctcgaagggctccagtatccttttgctgtgacgagctacgggaagaatctgtatttcacagactggaagatgaattccgtggttgctctcgatcttgcaatttccaaggagacggatgctttccaaccccacaagcagacccggctgtatggcatcaccacggccctgtctcagtgtccgcaaggccataactactgctcagtgaacaatggcggctgcacccacctatgcttggccaccccagggagcaggacctgccgttgccctgacaacaccttgggagttgactgtatcgaacggaaatgaagacaagagtgccttatttcctttccaagtatttcacagcaacactctacttgaagcaacttggtccagattgaaaagtgtcctctggctgagtggccactaggcccagacccagcccagcctgagccccaacaacaacttttccctcactgttccccaaaacatgcaccctggacttctctaatagaaaagtctccacccctacacaaggacagaaccctccacccctacccccaaccctcagacagacttatacacccctgagtgaggattacatgcccatcccagtgtcctaggaccttttcccaatactagccccccagtggtgaacagaacctcccaaatttgagttgcacccttccctgtggccttatgagctcagcctcgctttgaggtacccaccgtcctgtcagctccttgacctatgagctggggcctgactaggaaaagttgggagttaaggaggaaattagcattccttaatgttttgttttggtgctctgaatttcttctttattatagtcctatagttttactcctcagttcctcaccatcatcatcttgtctaagacccccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgctggcactgatgtccctcctttttcacggagacctatctgaggtacaggatggggctggcaccagatgatgtcccaccacagtccctcacctccggcctccacatgacagaaccaatttacactcaaccatgacctcacccctccttggtttctccctccccg

SEQ ID NO: 216 - protein, 1247 aa, Homo sapiens
MLASSSRIRAAWTRALLLPLLLAGPVGCLSRQELFPFGPGQGDLELEDGDDFVSPALELSGALRFYDRSDIDAVYVTTNGIIATSEPPAKESHPGLFPPTFGAVAPFLADLDTTDGLGKVYYREDLSPSITQRAAECVHRGFPEISFQPSSAVVVTWESVAPYQGPSRDPDQKGKRNTFQAVLASSDSSSYAIFLYPEDGLQFHTTFSKKENNQVPAVVAFSQGSVGFLWKSNGAYNIFANDRESIENLAKSSNSGQQGVWVFEIGSPATTNGVVPADVILGTEDGAEYDDEDEDYDLATTRLGLEDVGTTPFSYKALRRGGADTYSVPSVLSPRRAATERPLGPPTERTRSFQLAVETFHQQHPQVIDVDEVEETGVVFSYNTDSRQTCANNRHQCSVHAECRDYATGFCCSCVAGYTGNGRQCVAEGSPQRVNGKVKGRIFVGSSQVPIVFENTDLHSYVVMNHGRSYTAISTIPETVGYSLLPLAPVGGIIGWMFAVEQDGFKNGFSITGGEFTRQAEVTFVGHPGNLVIKQRFSGIDEHGHLTIDTELEGRVPQIPFGSSVHIEPYTELYHYSTSVITSSSTREYTVTEPERDGASPSRIYTYQWRQTITFQECVHDDSRPALPSTQQLSVDSVFVLYNQEEKILRYAFSNSIGPVREGSPDALQNPCYIGTHGCDTNAACRPGPRTQFTCECSIGFRGDGRTCYDIDECSEQPSVCGSHTICNNHPGTFRCECVEGYQFSDEGTCVAVVDQRPINYCETGLHNCDIPQRAQCIYTGGSSYTCSCLPGFSGDGQACQDVDECQPSRCHPDAFCYNTPGSFTCQCKPGYQGDGFRCVPGEVEKTRCQHEREHILGAAGATDPQRPIPPGLFVPECDAHGHYAPTQCHGSTGYCWCVDRDGREVEGTRTRPGMTPPCLSTVAPPIHQGPAVPTAVIPLPPGTHLLFAQTGKIERLPLEGNTMRKTEAKAFLHVPAKVIIGLAFDCVDKMVYWTDITEPSIGRASLHGGEPTTIIRQDLGSPEGIAVDHLGRNIFWTDSNLDRIEVAKLDGTQRRVLFETDLVNPRGIVTDSVRGNLYWTDWNRDNPKIETSYMDGTNRRILVQDDLGLPNGLHFDAFSSQLCWVDAGTNRAECLNPSQPSRRKALEGLQYPFAVTSYGKNLYFTDWKMNSVVALDLAISKETDAFQPHKQTRLYGITTALSQCPQGHNYCSVNNGGCTHLCLATPGSRTCRCPDNTLGVDCIERK

SEQ ID NO: 217 - DNA, 10558 bp, Homo sapiens
cagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttttccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagagatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggcggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccacagttcctggtcctcatctcgtctggaaagtctgacgatgaggtggtcgtcccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctaggggaagcggaggtgcccgtggcgctcctggagaacgaggcagaaccggtccactgggaagaaagggtgagcccggagagccaggaccaaaaggaggaatcgggaacccgggccctcgtggggagacgggagatgacgggagagacggagttggcagtgaaggacgcagaggcaaaaaaggagaaagaggatttcctggatacccaggaccaaagggtaacccaggtgaacctgggctaaatggaacaacaggacccaaaggcatcagaggccgaaggggaaattcgggacctccagggatagttggacagaaggggagacctggctacccaggaccagctggtccaaggggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgtcctgaccattgctgagagcaactgcccgacgggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaaactctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagtgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccgtccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagacggccactgttagacccccagtggcggtgaagccagcaacagcagcgaagcctgtagcagcaaagccagcagctgtaagaccccccgctgctgctgcaaaaccagtggcgaccaagcctgaggtccctaggccacaggcagccaaaccagctgccaccaagccagccaccactaagcccgtggttaagatgctccgtgaagtccaggtgtttgagataacagagaacagcgccaaactccactgggagaggcctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccagcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctcaatgttgtgtgttttttttttttgtgtgctggagggaggggatttaattttaattttaaaatgtttaggaaatttatacaaagaaactttttaataaagtatattgaaagtttaaaaaaaaaaaaaaaa

SEQ ID NO: 218 - protein, 3173 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKAEFLLNAHSSKDEVQNAVQRLRPKGGRQINVGNALEYVSRNIFKRPLGSRIEEGVPQFLVLISSGKSDDEVVVPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGARGAPGERGRTGPLGRKGEPGEPGPKGGIGNPGPRGETGDDGRDGVGSEGRRGKKGERGFPGYPGPKGNPGEPGLNGTTGPKGIRGRRGNSGPPGIVGQKGRPGYPGPAGPRGNRGDSIDQCALIQSIKDKCPCCYGPLECPVFPTELAFALDTSEGVNQDTFGRMRDVVLSIVNVLTIAESNCPTGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVSMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKTATVRPPVAVKPATAAKPVAAKPAAVRPPAAAAKPVATKPEVPRPQAAKPAATKPATTKPVVKMLREVQVFEITENSAKLHWERPEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 219 - DNA, 2806 bp, Homo sapiens
ggatccaggactgagatcccagaaccatgaacctggccatcagcatcgctctcctgctaacaggtacccggcatggggcaggactggggctccaggcgccctggcttccttccctccagagaagcagcttctccctcacagtctcagaaaagcgcaggtgacaaagagagggctctttttcatcctgaagtcagccgatccaccgcgctgatattctgacggcctgaggtggtttttggaaacacagtttgctgagccctccttcacactattgaactagaatccccaactgagaacccaggaaccagcatcaactccctaagatctcctgtccttgaaacacattgataggatccaaggctcaagcagagtggggagggaggctggggtctgcaaaggagaagtgggatccctggggtggggaaaggcactcagagagcagaccccggtcccctccctagccaggcccatctctccacttcaggtgggtgggaggcccctgtgccgcaggcccctccagtttgaaggaggcactgctggtgccagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaataccacatgaaggtcctctacttatccgccttcactagcaaggacgagggcacctacacgtgtgcactccaccactctggccattccccacccatctcctcccagaacgtcacagtgctcagaggtgagacaagcccctaacaaggtcaagtgagctgggagagccaggctcggggacagcaggcagttcccttggctggactagagaggagaatagccccataacgctctcaccctctcccaactgctgcctggtcaactggggaaccattgccttcggtgtgaatggggtgaagagctcagggccagacaggcagagcagtgtggttccaccagaactgtgggcaaggcctttggcccctaatcttccttctcccagcgggaaacagggatgacaccacctccctcagccagttttcttgtcatgatgtttagtaaggttttcataagatgatatgtgtgcaagagatcagtaatctgcaaatgggaaagatggctggttctgtgagaccaggctgttcctggtcccagctaagacattgcagtacccacctcccaaagggagtacacccttgctttgggcctgtgcctgcctgagtcctgatccgtcttccttcctaccctgcccccggcccccttctctttctgcagacaaactggtcaagtgtgagggcatcagcctgctggctcagaacacctcgtggctgctgctgctcctgctgtccctctccctcctccaggccacggatttcatgtccctgtgactggtggggcccatggaggagacaggaagcctcaagttccagtgcagagatcctacttctctgagtcagctgaccccctccccccaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgctgggcctagcacggacatggtctgtcctgacagcactcctcggcaggcatggctggtgcctgaagaccccagatgtgagggcaccaccaagaatttgtggcctaccttgtgagggagagaactgaggatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctgtcctcgtgtccacctggccttcgctcctccagcagtgcctgcctgcccccgctt

SEQ ID NO: 220 - protein, 161 aa, Homo sapiens
MNLAISIALLLTVLQVSRGQKVTSLTACLVDQSLRLDCRHENTSSSPIQYEFSLTRETKKHVLFGTVGVPEHTYRSRTNFTSKYHMKVLYLSAFTSKDEGTYTCALHHSGHSPPISSQNVTVLRDKLVKCEGISLLAQNTSWLLLLLLSLSLLQATDFMSL

SEQ ID NO: 221 - DNA, 736 bp, Homo sapiens
ggctctcaccctcctctcctgcagctccagctctgtgctctgcctctgaggagaccatggcccggcctctgtgtaccctgctactcctgatggctaccctggctggggctctggcctcgagctccaaggaggagaataggataatcccaggtggcatctatgatgcagacctcaatgatgagtgggtacagcgtgcccttcacttcgccatcagcgagtacaacaaggccaccgaagatgagtactacagacgcccgctgcaggtgctgcgagccagggagcagacctttgggggggtgaattacttcttcgacgtagaggtgggccgcaccatatgtaccaagtcccagcccaacttggacacctgtgccttccatgaacagccagaactgcagaagaaacagttatgctctttcgagatctacgaagttccctgggaggacagaatgtccctggtgaattccaggtgtcaagaagcctaggggtctgtgccaggccagtcacaccgaccaccacccactcccaccccctgtagtgctcccacccctggactggtggcccccaccctgcgggaggcctccccatgtgcctgtgccaagagacagacagagaaggctgcaggagtcctttgttgctcagcagggcgctctgccctccctccttccttcttgcttctaatagacctggtacatggtacacacacccccacctcctgcaattaaacagtagcatcgcc

SEQ ID NO: 222 - DNA, 594 bp, Homo sapiens
cccaccctgggacaggctctcaccctcctctcctgcagctccagctttgtgctctgcctctgaggagaccatggcccagcatctgagtaccctgctgctcctgctggccaccctagctgtggccctggcctggagccccaaggaggaggataggataatcccgggtggcatctataacgcagacctcaatgatgagtgggtacagcgtgcccttcacttcgccatcagcgagtataacaaggccaccaaagatgactactacagacgtccgctgcgggtactaagagccaggcaacagaccgttgggggggtgaattacttcttcgacgtagaggtgggccgaaccatatgtaccaagtcccagcccaacttggacacctgtgccttccatgaacagccagaactgcagaagaaacagttgtgctctttcgagatctacgaagttccctgggagaacagaaggtccctggtgaaatccaggtgtcaagaatcctagggatctgtgccaggccattcgcaccagccaccacccactcccaccccctgtagtgctcccacccctgggggccaatgggactgtgcaggagacagcgg

SEQ ID NO: 223 - protein, 141 aa, Homo sapiens
MARPLCTLLLLMATLAGALASSSKEENRIIPGGIYDADLNDEWVQRALHFAISEYNKATEDEYYRRPLQVLRAREQTFGGVNYFFDVEVGRTICTKSQPNLDTCAFHEQPELQKKQLCSFEIYEVPWEDRMSLVNSRCQEA

SEQ ID NO: 224 - protein, 141 aa, Homo sapiens
MAQHLSTLLLLLATLAVALAWSPKEEDRIIPGGIYNADLNDEWVQRALHFAISEYNKATKDDYYRRPLRVLRARQQTVGGVNYFFDVEVGRTICTKSQPNLDTCAFHEQPELQKKQLCSFEIYEVPWENRRSLVKSRCQES

SEQ ID NO: 225 - DNA, 5460 bp, Homo sapiens
cgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggcccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacagggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaata

SEQ ID NO: 226 - protein, 1466 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVQLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 227 - DNA, 6663 bp, Homo sapiens
ccccgactagcccgacagtccccgactagcccgacagccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaacgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattccgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttagagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaaaaaaaaaaaaaaaaaaaaaaaaaaaaaaaaa

SEQ ID NO: 228 - protein, 1202 aa, Homo sapiens
MVKCYHKKYRSATRDVIFRLQFHTGAVQGYGLVFGKEDLSKDDRFPDYGKVELVFSATPEKIQGSEHLYNDHGVIVDYNTTDPLIRWDSYENLSADGEVLHTQGPVDGSLYAKVRKKSSSDPGIPGGPQAIPATNSPDHSDHTLSVSSDSGHSTASARTDKTEERLAPGTRRGLSAQEKAELDQLLSGFGLEDPGSSLKEMTDARSKYSGTRHVVPAQVHVNGDAALKDRETDILDDEMPHHDLHSVDSLGTLSSSEGPQSAHLGPFTCHKSSQNSLLSDGFGSNVGEDPQGTLVPDLGLGMDGPYERERTFGSREPKQPQPLLRKPSVSAQMQAYGQSSYSTQTWVRQQQMVVAHQYSFAPDGEARLVSRCPADNPGLVQAQPRVPLTPTRGTSSRVAVQRGVGSGPHPPDTQQPSPSKAFKPRFPGDQVVNGAGPELSTGPSPGSPTLDIDQSIEQLNRLILELDPTFEPIPTHMNALGSQANGSVSPDSVGGGLRASSRLPDTGEGPSRATGRQGSSAEQPLGGRLRKLSLGQYDNDAGGQLPFSKCAWGKAGVDYAPNLPPFPSPADVKETMTPGYPQDLDIIDGRILSSKESMCSTPAFPVSPETPYVKTALRHPPFSPPEPPLSSPASQHKGGREPRSCPETLTHAVGMSESPIGPKSTMLRADASSTPSFQQAFASSCTISSNGPGQRRESSSSAERQWVESSPKPMVSLLGSGRPTGSPLSAEFSGTRKDSPVLSCFPPSELQAPFHSHELSLAEPPDSLAPPSSQAFLGFGTAPVGSGLPPEEDLGALLANSHGASPTPSIPLTATGAADNGFLSHNFLTVAPGHSSHHSPGLQGQGVTLPGQPPLPEKKRASEGDRSLGSVSPSSSGFSSPHSGSTISIPFPNVLPDFSKASEAASPLPDSPGDKLVIVKFVQDTSKFWYKADISREQAIAMLKDKEPGSFIVRDSHSFRGAYGLAMKVATPPPSVLQLNKKAGDLANELVRHFLIECTPKGVRLKGCSNEPYFGSLTALVCQHSITPLALPCKLLIPERDPLEEIAESSPQTAANSAAELLKQGAACNVWYLNSVEMESLTGHQAIQKALSITLVQEPPPVSTVVHFKVSAQGITLTDNQRKLFFRRHYPVNSVIFCALDPQDRKWIKDGPSSKVFGFVARKQGSATDNVCHLFAEHDPEQPASAIVNFVSKVMIGSPKKV

SEQ ID NO: 229 - DNA, 2320 bp, Homo sapiens
gcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaataccaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgttcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaaaaaaaaaaaaaaaaaaaaaaaaaaa

SEQ ID NO: 230 - protein, 500 aa, Homo sapiens
MRGELWLLVLVLREAARALSPQPGAGHDEGPGSGWAAKGTVRGWNRRARESPGHVSEPDRTQLSQDLGGGTLAMDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQRCSSGFDRYRQEWMDYGCAQEAEGRMCEDFQDEDHDSASPDTSFSPYDGDLTTTSSSLFIDSLTTEDDTKLNPYAGGDGLQNNLSPKTKGTPVHLGTIVGIVLAVLLVAAIILAGIYINGHPTSNAALFFIERRPHHWPAMKFRSHPDHSTYAEVEPSGHEKEGFMEAEQC

SEQ ID NO: 231 - DNA, 5540 bp, Homo sapiens; identical to SEQ ID NO: 176

SEQ ID NO: 232 - protein, 564 aa, Homo sapiens; identical to SEQ ID NO: 187

SEQ ID NO: 233 - DNA, 5086 bp, Homo sapiens; identical to SEQ ID NO: 213
  misc_feature (1)...(5086): n = A,T,C or G

SEQ ID NO: 234 - protein, 1366 aa, Homo sapiens; identical to SEQ ID NO: 214

SEQ ID NO: 235 - DNA, 4168 bp, Homo sapiens
atgggcaacctggagagcgccgagggggtcccgggagagcccccctctgtcccgttgttgctgccgcccggcaagatgccgatgcctgagccctgtgagctggaggaaaggttcgccctggtgctgagctccatgaacctgcctccagacaaggcccggctcctgcggcagtatgacaatgagaagaaatgggatctgatctgtgaccaggaacgattccaggtgaagaatcctccccacacttacattcagaaactccagagcttcttggaccccagtgtaactcggaagaagttcaggaggagggtgcaggagtcaaccaaagtactaagggagctggagatctctcttcgcaccaaccacattgggtgggtgcgggaatttctgaatgatgaaaacaaaggcctggatgtactggtggattacctgtcctttgcccagtgttctgtcatgtttgactttgagggtctggaaagtggtgacgatggtgcatttgacaaactccggtcctggagcaggtcaatcgaggacctgcagccacccagcgccctgtcggcccccttcaccaacagcctcgctcgctctgcgcgccagtctgtgctccggtatagcactctccctgggcgcagggccctgaagaactcccgcctagtgagccagaaggatgacgtccacgtctgtatcctttgtctcagagccatcatgaactatcagtacggattcaacctggtcatgtcccacccccatgctgtcaatgagattgcacttagcctcaataacaagaatccaaggaccaaagcccttgtcttagagcttctggcagctgtgtgtttggtgcgaggaggtcacgaaatcatccttgctgcctttgacaatttcaaagaggtatgcaaggagctgcaccgctttgagaagctgatggagtatttccggaatgaggacagcaatattgacttcatggtggcctgcatgcagttcatcaacatcgtggtgcactcggtggaggacatgaacttccgggtccacctgcagtatgagtttaccaagctggggctagaggagttcctgcagaagtcaaggcacacagagagcgagaagctgcaggtgcagattcaggcatatctggacaacgtgtttgatgtcgggggtttgttggaggatgctgagaccaagaatgtagccctggagaaggtggaggagttggaggagcatgtgtcccatctcacagagaagcttctggacctagagaatgaaaacatgatgcgggtggcagaactagagaagcagctgctacagcgggagaaggaactagagagcatcaaggagacatatgagaacacaagccaccaggtgcacaccctgcggaggctcattaaagagaaggaggaggcctttcagcgtcgatgtcatttggagccaaatgtccggggcctggagtctgtggacagtgaggccctggccagagtaggccctgcagagctgagtgagggcatgccaccctccgacctggaccttctggctccagccccaccccctgaggaggtcctgcctcttcctccaccaccagctccgcccttgccccctccacctcccccattaccagacaagtgtcccccagccccacctctccctggtgctgcaccctctgtggtgttgacagtgggcctgtcagccattcgaattaagaaacctatcaagaccaagttccggctgcctgtcttcaactggacagcactgaaacccaaccagatcagtggcactgtcttcagcgaacttgatgatgagaagatcttggaggacctggatcttgataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtttgacttgcagacactacctgtggacttcgtggagtgcctgatgcgcttcctgcccacagaggctgaggtaaagctgctgcggcaatatgagcgggagcggcagcccctggaggagttggcagctgaggaccgcttcatgctgctcttcagcaaggtggaacggttgacccagcgaatggctggcatggccttcctggggaacttccaggataacctgcagatgctcacaccgcaactcaatgccatcattgcggcgtccgcttccgtcaagtcttcacagaagctgaagcagatgttggagatcatacttgcactggggaactacatgaacagcagcaagcggggagctgtgtatggcttcaagctccagagcctggatctgctgctggataccaagtccactgaccggaagatgacactgcttcatttcatcgccttgacagtgaaggagaaatacccagacctggctaacttctggcatgagctgcactttgttgagaaggctgcagcagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggaggcctacaatgcagttgtgcgctactttggcgagagtcccaagactacacctccttctgtattcttcccagtatttgtccgattcattcgttcttacaaggaagcagaacaagagaatgaagcccgcaagaagcaggaggaggtaatgcgggagaagcagctggctcaggaagccaagaaactggatgccaagaccccatcccagcggaacaagtggcaacagcaggagttaatagcagagttgaggcggcgccaggccaaggaacaccggcctgtttatgaggggaaggatggtaccatcgaggacatcatcacagtgctgaagagtgtccctttcacggcccgtactgccaagcggggctcacgcttcttctgtgatgcagcccaccatgatgagtcaaactgttagcccccaaggttggggcccgacaggcctccactgccagcctatggttgttcgccaccaagccaggagtgctgcaccgcccagtggtccccctcgggctccaggcccccactgagaccctctcggaggcagaagcacttcacccctcagagtcctacaagtccaaccagtggacctggaattggccaagggctcaggagagggctgtgttgctctctcaaccatgtccgccccagctcttgaggctggatctttctacttgtgccactatgggcactaggtctgtaggtccctggtgcttccagtactgcactttgcccccaaggtctttgacttcatttcctgaagggtcaccaagggtcagctcagggctaggaaaaaccatttccagccttagcctaaacagggcacatagatctctcccactagagcccagagggatgagaggagagagcaactgttctttctttttttttcccttcctttttgcaggcccatggtcagctctggtctagatgtatctaggcttagggagccctgggaccctgccagtctcagttcatctcttaccaggagcaaggccctctgaagcatgggccgtgccagctgtgccctagtgataagggtaagaggagagatgtcaggctcactgcccttatttctctgcccatttcattctaggctcacactgtccttgtcaaggtgggcagaagagcagaggtcttctctgcaccaaccactctctgcagatggctggagaaagggtgtgccaactcttcaccttctttcctcagctacggtttttttttttttttttttttttggcaggggacaaggagcatggtggtcttggctatttgcttaccttcccgtttctcctctgcccctggaagggaatgtgggggcccacttttttgtacatgtaccacctccctttcctcttactgtacataaacctcagactctccccctctcaacaaaggcttgatgcaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 236 - protein, 1028 aa, Homo sapiens
MGNLESAEGVPGEPPSVPLLLPPGKMPMPEPCELEERFALVLSSMNLPPDKARLLRQYDNEKKWDLICDQERFQVKNPPHTYIQKLQSFLDPSVTRKKFRRRVQESTKVLRELEISLRTNHIGWVREFLNDENKGLDVLVDYLSFAQCSVMFDFEGLESGDDGAFDKLRSWSRSIEDLQPPSALSAPFTNSLARSARQSVLRYSTLPGRRALKNSRLVSQKDDVHVCILCLRAIMNYQYGFNLVMSHPHAVNEIALSLNNKNPRTKALVLELLAAVCLVRGGHEIILAAFDNFKEVCKELHRFEKLMEYFRNEDSNIDFMVACMQFINIVVHSVEDMNFRVHLQYEFTKLGLEEFLQKSRHTESEKLQVQIQAYLDNVFDVGGLLEDAETKNVALEKVEELEEHVSHLTEKLLDLENENMMRVAELEKQLLQREKELESIKETYENTSHQVHTLRRLIKEKEEAFQRRCHLEPNVRGLESVDSEALARVGPAELSEGMPPSDLDLLAPAPPPEEVLPLPPPPAPPLPPPPPPLPDKCPPAPPLPGAAPSVVLTVGLSAIRIKKPIKTKFRLPVFNWTALKPNQISGTVFSELDDEKILEDLDLDKFEELFKTKAQGPALDLICSKNKTAQKAASKVTLLEANRAKNLAITLRKAGRSAEEICRAIHTFDLQTLPVDFVECLMRFLPTEAEVKLLRQYERERQPLEELAAEDRFMLLFSKVERLTQRMAGMAFLGNFQDNLQMLTPQLNAIIAASASVKSSQKLKQMLEIILALGNYMNSSKRGAVYGFKLQSLDLLLDTKSTDRKMTLLHFIALTVKEKYPDLANFWHELHFVEKAAAVSLENVLLDVKELGRGMELIRRECSIHDNSVLRNFLSTNEGKLDKLQRDAKTAEEAYNAVVRYFGESPKTTPPSVFFPVFVRFIRSYKEAEQENEARKKQEEVMREKQLAQEAKKLDAKTPSQRNKWQQQELIAELRRRQAKEHRPVYEGKDGTIEDIITVLKSVPFTARTAKRGSRFFCDAAHHDESNC

SEQ ID NO: 237 - DNA, 5641 bp, Homo sapiens
cggaggaggacgcgagccccttgcgggcggtcatcacagcccagcctcggggctgccacagcgcgttgcgcctgtgcgccctcggtccccgcgtccactgagcgccgcgctcggggatggggcccggccggccggcccccgcgccctggcctcgtcacctgctgcgctgcgtcctgctcctcgggtgcctgcacctcggccgtcccggcgcccctggggacgccgccctcccggaacccaacgtcttcctcatcttcagccatggactgcagggctgcctggaggcccagggcgggcaggtcagagtcaccccggcttgcaataccagcctccctgcccagcgctggaagtgggtctcccgaaaccggctattcaacctgggtaccatgcagtgcctgggcacaggctggccaggcaccaacaccacggcctccctgggcatgtatgagtgtgaccgggaagcactgaatcttcgctggcattgtcgtacactgggtgaccagctgtccttgctcctgggggcccgcaccagcaacatatccaagcctggcacccttgagcgtggtgaccagacccgcagtggccagtggcgcatctacggcagcgaggaggacctatgtgctctgccctaccacgaggtctacaccatccagggaaactcccacggaaagccgtgcaccatccccttcaaatatgacaaccagtggttccacggctgcaccagcacgggccgcgaggatggtcacctgtggtgtgccaccacccaggactacggcaaagacgagcgctggggcttctgccccatcaagagtaacgactgcgagaccttctgggacaaggaccagctgactgacagctgctaccagtttaacttccagtccacgctgtcgtggagggaggcctgggccagctgcgagcagcagggtgcggatctgctgagcatcacggagatccacgagcagacctacatcaacggcctcctcactgggtacagctccaccctgtggatcggcttgaatgacttggacacgagcggaggctggcagtggtcggacaactcgcccctcaagtacctcaactgggagagtgaccagccggacaaccccagtgaggagaactgtggagtgatccgcactgagtcctcgggcggctggcagaaccgtgactgcagcatcgcgctgccctatgtgtgcaagaagaagcccaacgccacggccgagcccacccctccagacaggtgggccaatgtgaaggtggagtgcgagccgagctggcagcccttccagggccactgctaccgcctgcaggccgagaagcgcagctggcaggagtccaagaaggcatgtctacggggcggtggcgacctggtcagcatccacagcatggcggagctggaattcatcaccaagcagatcaagcaagaggtggaggagctgtggatcggcctcaacgatttgaaactgcagatgaattttgagtggtctgacgggagccttgtgagcttcacccactggcacccctttgagcccaacaacttccgggacagtctggaggactgtgtcaccatctggggcccggaaggccgctggaacgacagtccctgtaaccagtccttgccatccatctgcaagaaggcaggccagctgagccagggggccgccgaggaggaccatggctgccggaagggttggacgtggcacagcccatcctgctactggctgggagaagaccaagtgacctacagtgaggcccggcgcctgtgcactgaccatggctctcagctggtcaccatcaccaacaggttcgagcaggccttcgtcagcagcctcatctacaactgggagggcgagtacttctggacggccctgcaggacctcaacagcaccggctccttcttctggctcagtggggatgaagtcatgtacacccactggaaccgggaccagcccgggtacagccgtgggggctgcgtggcgctggccactggcagcgccatggggctgtgggaggtgaagaactgtacctcgttccgggcccgctacatctgccggcagagcctgggcactccagtgacgccggagctgccggggccagatcccacgcccagcctcactggctcctgtccccagggctgggcctcggacaccaaactccggtattgctataaggtgttcagctcagagcggctgcaggacaagaagagctgggtccaggcccagggggcctgccaggagctgggggcccagctgctgagcctggccagctacgaggaggagcactttgtggccaacatgctcaacaagatcttcggtgaatcagaacccgagatccacgagcagcactggttctggatcggcctgaaccgtcgggatcccagagggggtcagagttggcgctggagcgacggcgtagggttctcttaccacaatttcgaccggagccggcacgacgacgacgacatccgaggctgtgcggtgctggacctggcctccctgcagtgggtggccatgcagtgcgacacacagctggactggatctgcaagatccccagaggtacggacgtgcgggagcccgacgacagccctcaaggccgacgggaatggctgcgcttccaggaggccgagtacaagttctttgagcaccactccacgtgggcgcaggcgcagcgcatctgcacgtggttccaggccgagctgacctccgtgcacagccaggcagagctagacttcctgagccacaacttgcagaagttctcccgggcccaggagcagcactggtggatcggcctgcacacctctgagagcgatgggcgcttcagatggacagatggttccattataaacttcatctcctgggcaccaggcaaacctcggcctgtcggcaaggacaagaagtgcgtgtacatgacagccagccgagaggactggggggaccagaggtgcctgacagccttgccctacatctgcaagcgcagcaacgtcaccaaagaaacgcagcccccagacctgccaactacagccctggggggctgcccctctgactggatccagttcctcaacaagtgttttcaggtccagggccaggaaccccagagccgggtgaagtggtcagaggcacagttctcctgtgaacagcaagaggcccagctggtcaccatcacaaaccccttagagcaagcattcatcacagccagcctgcccaatgtgacctttgacctttggattggcctccatgcctcgcagagggacttccagtgggtggagcaggagcctttgatgtatgccaactgggcacctggggagccctctggccctagccctgctcccagtggcaacaaaccgaccagctgtgcggtggtcctgcacagcccctcagcccacttcactggccgctgggacgatcggagctgcacggaggagacccatggcttcatctgccagaagggcacggacccctccctgagcccgtccccagcagcgctgccccccgccccgggcactgagctctcctacctcaacggcaccttccggctgcttcagaagccgctgcgctggcacgatgccctcctgctgtgtgagagccacaatgccagcctggcctacgtgcccgacccctacacccaggccttcctcacgcaggctgcccgagggctgcgcacgccgctctggattgggctggctggcgaggagggctctcggcggtactcctgggtctcagaggagccgctgaactacgtgggctggcaggacggggagccgcagcagccggggggctgtacctacgtagatgtggacggggcctggcgcaccaccagctgtgacaccaagctgcagggggctgtgtgtggggttagcagtgggccccctcctccccgaagaataagctaccatggcagctgtccccagggactggcagactccgcgtggattcccttccgggagcactgctattctttccacatggagctgctgctgggccacaaggaggcgcgacagcgctgccagagagcgggtggggccgtcctgtctatcctggatgagatggagaatgtgtttgtctgggagcacctgcagagctatgagggccagagtcggggcgcctggctgggcatgaacttcaaccccaaaggaggcactctggtctggcaggacaacacagctgtgaactactccaactgggggcccccgggcttgggccccagcatgctgagccacaacagctgctactggattcagagcaacagcgggctatggcgccccggcgcttgcaccaacatcaccatgggtgtcgtctgcaagcttcctcgtgctgagcagagcagcttctccccatcagcgcttccagagaacccagcggccctggtggtggtgctgatggcggtgctgctgctcctggccttgctgaccgcagccctcatcctttaccggaggcgccagagcatcgagcgcggggcctttgagggtgcccgctacagccgcagcagctccagccccaccgaggccactgagaagaacatcctggtgtcagacatggaaatgaatgagcaacaagaatagagccaggcgcgtgggcagggccagggcgggaggagctggggagctggggccctgggtcagtctggccccccaccagctgcctgtccagttggcctatggaagggtgcccttgggagtcgctgttgggagccggagctgggcagagcctgggctggtggggtgccaccctcccacaagggctgggctgagacccagctgagtgcagcgtggcgtttccctttctgggggggcctgaggtcttgtcacctggtcctgtgcccccacaggaaccagaggtaggatgggagggggaacgagagcctctttctccccagagcccccggcccaggcctgttgatccgcgccccaggacccccttctttgcagagcccgaggagcctcccctgtcccctcgggcagatctgttgtgtctctcttcccacctggcagcctcagctctgtgcccctcaccctgctccctctcgccccttctctcccaccccttccttctgagccgggccctggggattggggagccctcttgttcctgatgagggtcagctgagggggctgagcatccatcactcctgtgcctgctggggtggctgtggggcgtggcaggaggggcctaggtgggttgggcctgagaaccagggcacgggtgtggtgtctgctgggctggagataagactggggagagacaccccaacctcccagggtgggagctgggccgggctgggatgtcatctcctgccgggcgggggagggctctgcccctggaagagtcccctgtggggaccaaaataagttccctaacatctccagctcctggctctggtttggagcaaggggaagggttgccagagtcctgggggccccagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgttttt

SEQ ID NO: 238 - protein, 1479 aa, Homo sapiens
MGPGRPAPAPWPRHLLRCVLLLGCLHLGRPGAPGDAALPEPNVFLIFSHGLQGCLEAQGGQVRVTPACNTSLPAQRWKWVSRNRLFNLGTMQCLGTGWPGTNTTASLGMYECDREALNLRWHCRTLGDQLSLLLGARTSNISKPGTLERGDQTRSGQWRIYGSEEDLCALPYHEVYTIQGNSHGKPCTIPFKYDNQWFHGCTSTGREDGHLWCATTQDYGKDERWGFCPIKSNDCETFWDKDQLTDSCYQFNFQSTLSWREAWASCEQQGADLLSITEIHEQTYINGLLTGYSSTLWIGLNDLDTSGGWQWSDNSPLKYLNWESDQPDNPSEENCGVIRTESSGGWQNRDCSIALPYVCKKKPNATAEPTPPDRWANVKVECEPSWQPFQGHCYRLQAEKRSWQESKKACLRGGGDLVSIHSMAELEFITKQIKQEVEELWIGLNDLKLQMNFEWSDGSLVSFTHWHPFEPNNFRDSLEDCVTIWGPEGRWNDSPCNQSLPSICKKAGQLSQGAAEEDHGCRKGWTWHSPSCYWLGEDQVTYSEARRLCTDHGSQLVTITNRFEQAFVSSLIYNWEGEYFWTALQDLNSTGSFFWLSGDEVMYTHWNRDQPGYSRGGCVALATGSAMGLWEVKNCTSFRARYICRQSLGTPVTPELPGPDPTPSLTGSCPQGWASDTKLRYCYKVFSSERLQDKKSWVQAQGACQELGAQLLSLASYEEEHFVANMLNKIFGESEPEIHEQHWFWIGLNRRDPRGGQSWRWSDGVGFSYHNFDRSRHDDDDIRGCAVLDLASLQWVAMQCDTQLDWICKIPRGTDVREPDDSPQGRREWLRFQEAEYKFFEHHSTWAQAQRICTWFQAELTSVHSQAELDFLSHNLQKFSRAQEQHWWIGLHTSESDGRFRWTDGSIINFISWAPGKPRPVGKDKKCVYMTASREDWGDQRCLTALPYICKRSNVTKETQPPDLPTTALGGCPSDWIQFLNKCFQVQGQEPQSRVKWSEAQFSCEQQEAQLVTITNPLEQAFITASLPNVTFDLWIGLHASQRDFQWVEQEPLMYANWAPGEPSGPSPAPSGNKPTSCAVVLHSPSAHFTGRWDDRSCTEETHGFICQKGTDPSLSPSPAALPPAPGTELSYLNGTFRLLQKPLRWHDALLLCESHNASLAYVPDPYTQAFLTQAARGLRTPLWIGLAGEEGSRRYSWVSEEPLNYVGWQDGEPQQPGGCTYVDVDGAWRTTSCDTKLQGAVCGVSSGPPPPRRISYHGSCPQGLADSAWIPFREHCYSFHMELLLGHKEARQRCQRAGGAVLSILDEMENVFVWEHLQSYEGQSRGAWLGMNFNPKGGTLVWQDNTAVNYSNWGPPGLGPSMLSHNSCYWIQSNSGLWRPGACTNITMGVVCKLPRAEQSSFSPSALPENPAALVVVLMAVLLLLALLTAALILYRRRQSIERGAFEGARYSRSSSSPTEATEKNILVSDMEMNEQQE

SEQ ID NO: 239 - DNA, 6127 bp, Homo sapiens
ctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaataaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctctgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagaggaagatgaggggaaggtggtggtcaggctgtcagaagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccatctgcccagagaaactaccagagctcttctcctctcccgactgtgggcagtagctacagcagccccgactactcacttcagcatttcagctcctctccggaaagccaggcccgagctcagttcagtgtggctggcgtccacacggtgcctgggagccctcaggcgcgccacagaacagtgggcaccaacactccccctagtcctggcttcggccggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggcggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggttgcttcgcctgtgcccagcggcatgtccagtcccagcgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttg

SEQ ID NO: 240 - protein, 1732 aa, Homo sapiens
MSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKINNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGVTRRRIQPEEDEGKVVVRLSEEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGRRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVASPVPSGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFINSVDMESLTGPQAISKATSETLAADPTPAATIVHFKVSAQGITLTDNQRKLFFRRHYPLNTVTFCDLDPQERKWMKTEGGAPAKLFGFVARKQGSTTCHLFAELDPNQPASAIVNFVSKVMLNAGQKR

SEQ ID NO: 241 - DNA, 3557 bp, Homo sapiens
atgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagcc

SEQ ID NO: 242 - protein, 986 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSDKDECSKDNGGCQQDCVNTFGSYECQCRSGFVLHDNKHDCKEAGCDHKVTSTSGTITSPNWPDKYPSKKECTWAISSTPGHRVKLTFMEMDIESQPECAYDHLEVFDGRDAKAPVLGRFCGSKKPEPVLATGSRMFLRFYSDNSVQRKGFQASHATECGGQVRADVKTKDLYSHAQFGDNNYPGGVDCEWVIVAEEGYGVELVFQTFEVEEETDCGYDYMELFDGYDSTAPRLGRYCGSGPPEEVYSAGDSVLVKFHSDDTITKKGFHLRYTSTKFQDTLHSRK

SEQ ID NO: 243 - DNA, 5015 bp, Homo sapiens
gcgctccgcacctgggcactcccagcgatgcgcagcggggcagcgccggccccgccgatggagctgctgttgctgccgccgccgccgcccggagcgccccgctccgcccgcgccccgtgcgcctgagcaccgagctcgcccctcctccgcgctaactccgccgcccgctccccaggccgcccgcgctccccgcgcgcctcctcgggctccacgcgtcttgccccgcagaggcagcctcctccaggagcggggccctgcacaccatggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgccttgacctggacagaaataatatcaccaggatcaccaagatggacttcgctgggctcaagaacctccgagtcttgcatctggaagacaaccaggtcagcgtcatcgagagaggcgccttccaggacctgaagcagctagagcgactgcgcctgaacaagaataagctgcaagtccttccagaattgcttttccagagcacgccgaagctcaccagactagatttgagtgaaaaccagatccaggggatcccgaggaaggcgttccgcggcatcaccgatgtgaagaacctgcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgccaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggtttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctccgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaa

SEQ ID NO: 244 - protein, 1523 aa, Homo sapiens
MAPGWAGVGAAVRARLALALALASVLSGPPAVACPTKCTCSAASVDCHGLGLRAVPRGIPRNAERLDLDRNNITRITKMDFAGLKNLRVLHLEDNQVSVIERGAFQDLKQLERLRLNKNKLQVLPELLFQSTPKLTRLDLSENQIQGIPRKAFRGITDVKNLQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIAKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 245 - DNA, 4227 bp, Homo sapiens
gactgggagcaggcagcccgggcggagcgggccggtgccgaggacggccccaggcattgctctgccccgggcattgcgcggcgcgcgtgagggggatgcggcaggaggcggcgcggcgggaggagtaggcggcggcgccctcgggagggagctgcgcgcgggccagacggcgcccggaggctccgcagtgccgccgccgtcgcccgggaggctccgcgcgggagccatgtaaccctgcggcgggctccgggctgctccgtccttccccagctcccgggctagcgcggcagcggggccacgatgaagaagcagttcaatcgcatgcgccagctggccaaccagacggtgggcagggctgaaaagacagaagttttgagtgaagaccttcttcaggtggagaagcgtctggagctggtgaaacaggtgtcccacagcacgcacaagaagctcaccgcatgtctgcagggccagcaaggggcagaggctgacaagcgctccaaaaagttgcctttgacaacactggctcagtgtctgatggaggggtcagctatcctgggagatgacacacttcttgggaagatgctgaaactctgtggagagacggaggacaagctggctcaggagctgatacattttgagttgcaagtagagagagacgtgattgagcccctgtttttgctggcggaggtggaaatcccaaatattcaaaagcagaggaaacacttagccaagttggtgctggacatggattcctcacgaaccaggtggcagcagacttccaagtcttcaggtttgtccagcagcttacagcctgcgggtgccaaggctgatgccctcagggaagaaatggaagaggctgccaacagagtggagatttgcagggaccagctctcagctgatatgtacagttttgtggccaaagaaattgactatgcaaactactttcaaacgctaatagaagtgcaagctgaataccacaggaagtccctgacactattgcaggctgtattgcctcagatcaaagcacaacaggaggcctgggtagagaagccttccttcgggaagccgctggaggagcacctcaccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaatttttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatggccttaggaaaatccaaagcatgggtgtgagggtcatggacacaaactgggtggctcgaagaggctcctcggccggtcggaaagtgtcctgcgccccgccctccatgcagcctcccgccccgcccgccgagctggctgcgcccctgccttcgccgctgccggagcagcccctggacagccccgcggcccccgcgctctctccatccggcctgggcctccagcctgggcccgagcgcaccagcacaacaaaaagcaaggaactttctccaggctctgcacagaaaggaagtccaggctccagccagggcacagcctgtgcagggactcaaccaggggctcaacctggagctcagccgggcgccagccccagccccagccagccgcctgcagaccagagtcctcacaccctccggaaagtttcaaagaagctggcaccgattccacccaaggtcccctttggccagccgggggctatggcagaccagtccgctggccagctgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacagatcttgtccactttgatattccctcgatccacatagagctcgggtcgacgctccgcctgagtcccctggagcacatgcggcgacactcagtaactgacaagagggactcggaggaggagtctgagagcaccgccctctgacatgacaccgcccatcctgcctcgcgtgtacatacatcacgggccctaggaacgccgccaggagcagcgtccatgagcttgccaagtgttctctgctggctctttcctgccactgccaacacgaggttggaatttggcagaaaattgtgatctccagtccgtgtggtgatgctggtggtgcaggttttgtttgttcctttcgggtggtgacttcggccttttgtttgacctttgccttttgactttgtgcctcttttgatccactttcagcctccatgccagaaaacacccacctctccatccaaggctggtcaggaacgtcctttgcagggtcggggtggtgcgggagaggctcactttgcctggttagacccaagggctgctaccttttccttggacggctcatgtcaggtcttgcaggatcagtttaatggccacagaaaggaagcaggacagcagggcccctctcacccacaactggaccaggtccaggattctagcagtcctggggcactgacctttgccagctacctgggggagggcttgccactggaaaacctttcaggccgcccccatcagtgggctccaaagtaaatggctgaaaacaaaaatgtttcacttcctaacagttttcctttttccactgtgtgactgaaagctcctatatcattttatatttctgaatctataaaacaaaacaaacaagcctgaaagtgtctggaggagccaaaggtggcctccctgtccccaaatatattggctatatgagagtaattttacccctctacgtacctaaaggcacccagttcactagtctgtggggtcctggagcctgtctcttctttctggaggttcaaactgaatagcaataattacgttacccaaagcatgtggaggaaaagtgaaaccagccacggagacgctggcccacggctcggcctgcggtgtggcctgctttgctcaccagcgtcagccgctcatttccttctcatgaagtcccatctggtcatggggacgagggccgggagggcaccgggtagccttttcacacttggggattaggggagtgagaaaagatttgggccatgcatgcaaagtcaaagtttaaaattttatccttttcaaatagatgatataatatacctatacatgatataatatttgtatatatgaaatctctctatatttgtttaatttgagccattcaatctaaaccaatgtacaggtgtacaatgaaaaatttaaatgcttagttatttttcccaacacagtgtaaagtcaccctcctctgagagtgggatgtgcagagttttgatgttgcagctttgctcacttcctggcaagggcaggtcatgcctcaatttgtaatgggagtctggggtaagggtgggggttgaaagttgttatctttaaatacatgtacaaatcgttgtcaaaagtaacgttattaaaatagatttattatccctg

SEQ ID NO: 246 - protein, 818 aa, Homo sapiens
MKKQFNRMRQLANQTVGRAEKTEVLSEDLLQVEKRLELVKQVSHSTHKKLTACLQGQQGAEADKRSKKLPLTTLAQCLMEGSAILGDDTLLGKMLKLCGETEDKLAQELIHFELQVERDVIEPLFLLAEVEIPNIQKQRKHLAKLVLDMDSSRTRWQQTSKSSGLSSSLQPAGAKADALREEMEEAANRVEICRDQLSADMYSFVAKEIDYANYFQTLIEVQAEYHRKSLTLLQAVLPQIKAQQEAWVEKPSFGKPLEEHLTISGREIAFPIEACVTMLLECGMQEEGLFRVAPSASKLKKLKAALDCCVVDVQEYSADPHAIAGALKSYLRELPEPLMTFELYDEWIQASNVQEQDKKLQALWNACEKLPKANHNNIRYLIKFLSKLSEYQDVNKMTPSNMAIVLGPNLLWPQAEGNITEMMTTVSLQIVGIIEPIIQHADWFFPGEIEFNITGNYGSPVHVNHNANYSSMPSPDMDPADRRQPEQARRPLSVATDNMMLEFYKKDGLRKIQSMGVRVMDTNWVARRGSSAGRKVSCAPPSMQPPAPPAELAAPLPSPLPEQPLDSPAAPALSPSGLGLQPGPERTSTTKSKELSPGSAQKGSPGSSQGTACAGTQPGAQPGAQPGASPSPSQPPADQSPHTLRKVSKKLAPIPPKVPFGQPGAMADQSAGQLSPVSLSPTPPSTPSPYGLSYPQGYSLASGQLSPAAAPPLASPSVFTSTLSKSRPTPKPRQRPTLPPPQPPTVNLSASSPQSTEAPMLDGMSPGESMSTDLVHFDIPSIHIELGSTLRLSPLEHMRRHSVTDKRDSEEESESTAL

SEQ ID NO: 247 - DNA, 2850 bp, Homo sapiens
tcccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccgggctccagtccttgtggcgctggcccttattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtggccgtgtgtgtggagtgggctgcagcgtcaggcggggcgggctggtggcctgggggccccagaggctgctgtctggatcctgggctgctgcccaggatggggctcccgcgtgctcttgcgctgccctctggtggccgctctgggtccttgcaccccgacccaggggccagcctgccctgtcctgtcctgataccgaggtgggagccctgccttggccagggtggccgtgttgacggttcttgggactgtgacattggaaggcgaggcaggtcaccagcactgtcctctgcaggatgggctgggattcatttggcagcttctcagggcctgtgtccggctggttggtccctgtgctgcccaaaccaggtgtccacatttccggctccgaggcgcagagaagggggcaggtggtggcttgggtggaggaagtcaccatccatcagcccagggagggagggtaccacctgggcacctggggctggatgtgagaggcctggaccagggcccgccggagggcgtggaccagatgctcatgtgttcctgggtgcagtgtctgtgttgggggctggccccaccctgggccagggtgcatggagggcatggccccagcggggaggaaggtgggcctagggctggctccagggtgtggagagcctgggagtggtctccgtcctggggccccaggaggttcccgcaaggagcgactggggcaggtgctggaggaggtcagtggacaagatggggagatgtggaaaccccaaaagccccttttcaggcagccctgcctccaagaccgacagatggctaagggggccgcagacctggctcccccagctcctgtgtggagaaagggcaacagctgtcccggatggttattctctcctttcctcaaacacatttggaactcaagtaaatccgatgcatgttgggtgaaaaaaaaaaaaaaaaaaaaaa

SEQ ID NO: 248 - protein, 173 aa, Homo sapiens
MARMNRPAPVEVSYKHMRFLITHNPTNATLSTFIEDLKKYGATTVVRVCEVTYDKTPLEKDGITVVDWPFDDGAPPPGKVVEDWLSLVKAKFCEAPGSCVAVHCVAGLGRAPVLVALALIESGMKYEDAIQFIRQKRRGAINSKQLTYLEKYRPKQRLRFKDPHTHKTRCCVM

SEQ ID NO: 249 - DNA, 3853 bp, Homo sapiens
gaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggcattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgttgttctacgctgctgcgtatcattcaatgttgatgtgaaaaactcaatgactttcagcggcccggtggaagacatgtttggatatactgttcaacaatatgaaaatgaagaaggaaaatgggtgcttattggttctccgttagttggccaacccaaaaacagaactggagatgtctataagtgtccagttgggagaggtgaatcattaccttgcgtaaagttggatctaccagttaatacatcaattcccaatgtcacagaagtaaaggagaacatgacatttggatcaactttagtcaccaacccaaatggaggatttctggcttgtgggcccttatatgcctatagatgtggacatttgcattacacaactggaatctgttctgacgtcagccccacatttcaagtcgtgaattccattgcccctgtacaagaatgcagcactcaactggacatagtcatagtgctggatggttccaacagtatttacccatgggacagtgttacagcttttttaaatgacctcttgaaaagaatggatattggtcctaaacagacacaggttggaattgtacagtatggagaaaacgtgacccatgagttcaacctcaataagtattcttccaccgaagaggtacttgttgcagcaaagaaaatagtccagagaggtggccgccagactatgacagctcttggaacagacacagcaagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaagccacagctgaccagtcagcagcttcatttgaaatggaaatgtctcagactggcttcagtgctcattattcacaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggttacactgtaaactctgctactgcttcttctggagatgtgctctatattgctggacagcctcggtacaatcatacaggccaggtcattatctacaggatggaagatggaaacatcaaaattctccagacgctcagtggagaacagattggttcctactttggcagtattttaacaacaactgacattgacaaggattctaatactgacattcttctagtcggagcccctatgtacatgggaacagagaaggaggagcaaggaaaagtgtatgtgtatgctctcaatcagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaacgtattccatcaggtggggatggtaagacactgaaattttttggccagtctatccacggagaaatggatttaaatggtgacggtctgacagatgtgactattgggggccttggtggtgctgccctcttctggtcccgagatgtggccgtagttaaagtgaccatgaattttgagccaaataaagtgaatattcaaaagaaaaactgccatatggagggaaaggaaacagtatgcataaatgctacagtgtgttttgaggttaaattaaagtctaaagaagacacgatttatgaagctgatttgcagtaccgtgtcaccctagattcactaagacaaatatcacgaagttttttctctggaactcaagagagaaaggttcaaaggaacatcacagttcgaaaatcagaatgcactaagcactccttctacatgttggacaagcatgactttcaggactctgtgagaataacgttggactttaatcttaccgatccagaaaatgggcctgttcttgatgattctctaccaaactcagtacatgaatatattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggctatccaaaaagacagttgtgaatctaatcataatatcacatgtaaagttggatatcccttcctgagaagaggagagatggtaactttcaaaatattgtttcagtttaacacatcctatctcatggaaaatgtgaccatttatttaagtgcaacaagtgacagcgaagaacctcctgaaaccctttctgataatgtagtaaacatttctatcccggtaaaatatgaagttggactacagttttacagctctgcaagtgaataccacatttcaattgctgccaatgagacagtccctgaagttattaattctactgaggacattggaaatgaaattaatatcttctacttgattagaaaaagtggatcttttccaatgccagagcttaagctgtcaatttcattccccaatatgacatcaaatggttaccctgtgctgtacccaactggattgtcatcttctgagaatgcaaactgcagaccccatatctttgaggatcctttcagtatcaactctggaaagaaaatgactacatcaactgaccatctcaaacgaggcacaattctggactgcaatacatgtaaatttgctaccatcacatgtaatctcacttcttctgacatcagccaagtcaatgtttcgcttatcttgtggaaaccaacttttataaaatcatatttttccagcttaaatcttactataaggggagaacttcggagtgaaaatgcatctctggttttaagtagcagcaatcaaaaaagagagcttgctattcaaatatccaaagatgggctaccgggcagagtgccattatgggtcatcctgctgagtgcttttgccggattgttgctgttaatgctgctcattttagcactgtggaagattggattcttcaaaagaccactgaaaaagaaaatggagaaatga

SEQ ID NO: 250 - protein, 1179 aa, Homo sapiens
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLKRMDIGPKQTQVGIVQYGENVTHEFNLNKYSSTEEVLVAAKKIVQRGGRQTMTALGTDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFEVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 251 - DNA, 5010 bp, Homo sapiens
atggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccccgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccaggactgcgtggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggacaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataa

SEQ ID NO: 252 - protein, 1669 aa, Homo sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMPGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 253 - DNA, 2798 bp, Homo sapiens
gccctctcccacagcggagtccaaaacaggcctaccagtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaaacttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacattgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcgtaagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaatccctaaaaactctctatactctctataacaatactttatcaagaactctggacaatggtattatttttaaaaatcatggtgatgtatttattagaatgtttcttataaatctctttcatttttatattaagaattaaactgtacctaaaaaaactctgactattcccatttctcagtttagcattacattgtcttgagcaccagaaaataaaatccatatattaattaaaacctatcttgaaaaaaaaaaaaaaaaaaaaaaaaaaaa

SEQ ID NO: 254 - protein, 750 aa, Homo sapiens
MLRAKNQLFLLSPHYLRQVKESSGSRLIQQRLLHQQQPLHPEWAALAKKQLKGKNPEDLIWHTPEGISIKPLYSKRDTMDLPEELPGVKPFTRGPYPTMYTFRPWTIRQYAGFSTVEESNKFYKDNIKAGQQGLSVAFDLATHRGYDSDNPRVRGDVGMAGVAIDTVEDTKILFDGIPLEKMSVSMTMNGAVIPVLANFIVTGEEQGVPKEKLTGTIQNDILKEFMVRNTYIFPPEPSMKIIADIFEYTAKHMPKFNSISISGYHMQEAGADAILELAYTLADGLEYSRTGLQAGLTIDEFAPRLSFFWGIGMNFYMEIAKMRAGRRLWAHLIEKMFQPKNSKSLLLRAHCQTSGWSLTEQDPYNNIVRTAIEAMAAVFGGTQSLHTNSFDEALGLPTVKSARIARNTQIIIQEESGIPKVADPWGGSYMMECLTNDVYDAALKLINEIEEMGGMAKAVAEGIPKLRIEECAARRQARIDSGSEVIVGVNKYQLEKEDAVEVLAIDNTSVRNRQIEKLKKIKSSRDQALAEHCLAALTECAASGDGNILALAVDASRARCTVGEITDALKKVFGEHKANDRMVSGAYRQEFGESKEITSAIKRVHKFMEREGRRPRLLVAKMGQDGHDRGAKVIATGFADLGFDVDIGPLFQTPREVAQQAVDADVHAVGVSTLAAGHKTLVPELIKELNSLGRPDILVMCGGVIPPQDYEFLFEVGVSNVFGPGTRIPKAAVQVLDDIEKCLEKKQQSV

SEQ ID NO: 255 - DNA, 806 bp, Homo sapiens
agcctgggtgacagagtaagactgtcgccaaaaaagaggaaaaaagttatccagtgcagtttctacagagataaaagaagtaatagttctggctgggtgtggtggcttatgcctgtaatcccaacactttgggaggccaaggcaggtggatcacatgaggtcaggagttcgagaccagcctggccaacatggcaaaactgtctctactaaaaatataaaaattaggtatggtggcacgtgcctgtacttacagctacttgggaggctgaggcatgagatgacaatctcttgaacccaggaggcggaggttgcagtgagctgagattgcaccactgcactccagcttgggtgatggagtgagactcaaataaaaaaggtactagttctgcatttcagagttggcttgttgaaccaggctatatgcttccaagatttaaatgtttttctgtattatactctcaattgtgttttaaaaaaatctcttacagaaatctctacctcaggcactaagtgttatgacatgggtagcatattgatattgaaaacttagctaggacttccagccttttaagataatttaaatgtaaaattaaatggttaaccagcaatctaatgtcatgtggtgtgcagtttggatattgcatgaacagctaaggaatcacctgttctagtgccaaagatcactcattgctaattttgttctgtacagcttatgtaatattttcatggtggagacggactctgtgtgctcagggccttgtctctaggaagattttgtcaattccaaatacagttttgaagattca

SEQ ID NO: 256 - DNA, 9192 bp, Homo sapiens
atgcggagtaggcttcccccagcgcttgccgccctgggcgcggccctactcctgtcttccattgaggcagaagttgacccaccttcagacttgaattttaaaattatagatgaaaatactgttcatatgtcatgggcagaaccagttgatccaattgtgggttacagaataacggtggaccctacaacggatgggcctactaaagaatttaccctttcagctagtaccactgaaactttattgtcagaacttgtacctgaaacagagtatgtggtgacaataacttcatatgatgaagtagaagaaagtgtaccagttataggacaactaacaattcaaacaggtagttcgacaaagccagtggagaagaaacctggaaaaaccgagatacaaaaatgctctgtcagtgcctggactgatttggttttcctcgtggatggctcttggagtgtgggaagaaataatttcaagtacattttagacttcattgctgctcttgtgtctgcttttgacattggggaagagaagacaagagttggagttgttcaatacagctctgacaccaggactgaatttaacttaaatcagtactaccaaagggatgaacttcttgctgcaataaaaaaaattccatataaaggtggcaacacaatgacaggggatgccattgattatttagttaaaaatactttcacggaatctgctggggcaagagttggctttcctaaagtggcaattattattacggatggaaaatcccaggatgaagtggaaattccagcaagagagcttcgtaatgttggagttgaagttttctccttgggcattaaagctgcagatgcaaaagaactcaaacaaattgcctccacaccttcactgaaccatgttttcaatgtggccaactttgatgcaattgtggatattcagaatgagatcatctcccaggtgtgctcaggagttgatgagcagcttggtgaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacggagtaccagatcagtgtttccgccatgaagggaatgacatccagtgaacccatttcaataatggagaagactcagccaatgaaagttcaagtggaatgttcacgtggtgtggatataaaagccgatattgtgtttttggttgatggctcctatagcattgggattgcaaactttgttaaagttagagcctttttggaagttcttgtaaaaagttttgaaatttcaccaaatagggtccagattagtcttgtgcaatacagccgggatcctcatactgagttcactttgaaaaaattcaccaaagttgaagatataattgaagcaataaacaccttcccttacagaggaggatctacaaatactggcaaagcaatgacttatgtcagagagaaaatatttgtgcctagcaagggatcaagaagcaatgtgccaaaggtcatgattcttatcacggatgggaaatcatcagatgctttcagagatcctgcgataaaactgaggaattcagatgttgaaatctttgcagttggtgtgaaggatgccgttcgctcagaattggaagctattgcctctcctcctgcagagacccatgtgttcacagtggaagattttgatgcttttcagaggatatcttttgaactcacacagtctatctgtcttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggtcaatgtgactgcggagtatgaggatggcttcagcattcccttagctggagaggagaccaccgaagaagtaaaaggagcacctcgaaacctaaaggtgacagatgagactacagatagtttcaaaattacttggactcaagctccagggagagttttaagatgtcgaattatatatagaccagttgctggtggagagagcagagaagttaccaccccacccaatcagaggaggagaacactggagaacttgattccagacacgaaatatgaagtatctgtaattcctgaatacttctcaggacctggtactccattaactggaaatgcagccactgaagaagttagagggaatccaagagacttaagagtttctgaccctacgacgtctactatgaaattatcttggagtggggcaccaggaaaagtgaaacagtatctcgtcacatataccccagtggcagggggtgaaactcaagaggtcactgtgaggggagatacaaccaatacggtgctgcagggattgaaggaagggacacaatacgccttatctgtgacagcactgtatgcgtctggggctggcgacgccctctttggtgaaggaacaacacttgaagaacgtggttctcctcaagatttagttactaaagacatcactgacacatcaattggggcttattggacatctgctccaggaatggttcgcggttacagggtctcatggaaatcactttatgatgatgttgacactggagagaaaaatctgcctgaagatgcaattcatacgatgatagaaaatctgcagccagagaccaaatacagaatttcagtatttgccacttacagcagtggagaaggagaacctttgactggagatgccacaactgaattatctcaagattccaaaaccctgaaagtagatgaagaaacagaaaacacaatgagagttacatggaaaccagcaccagggaaagtcgtcaactaccgtgttgtctatcgccctcatgggagagggaagcaaatggttgctaaggtgccccccacagtcacttcgacagtgttaaagcgacttcagccacagaccacatatgacatcacagttcttcctatttacaagatgggagaaggaaagcttaggcaaggatcaggaacaacagcttctcggtttaagtctcctagaaacctcaaaacatctgacccaaccatgtcaagcttccgagtgacttgggagcctgcccctggggaagtgaagggttataaagtcacattccaccctacgggggatgacagaagactgggggagttagtggttggaccctatgacaacacagttgttttggaggaacttagggctggtaccacctataaagtaaatgtttttggaatgtttgatggaggagaaagctcaccacttgttggacaagaaatgacaaccctttccgacacaactgttatgccaattttatcttctgggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgactacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttggggaccttttggaagctcagataagatggagaccatcttaaatggagatgaaaacactttggtgttcgaaaacctgaaccccaacaccatctatgaagtttccattactgccatctatgctgatgagtcagaaagtgatgacctgattggcagtgagcgcactctgcctatcttaacaacacaagctcccaaaagtgggccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcactctgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacaggctcggtgttcgctgggaccctgcaccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaaccaggggacaagaaattacagtgcgtggatcagaaaccagtcactgcttcactggcctttcaccagacactgattatggtgtcactgtttttgtgcagacaccaaatctcgagggaccaggagtctctgttaaagaacataccactgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacagtgcaatgggacccaggggcccaccagggcggccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctgggcccccaggtccacaaggagaatccagaacaggtccaccagggtccacaggttcaagaggtccccctggcccccctggccgtcctggaaactcaggtatccagggccccccaggtcctcctggatactgtgattcttctcagtgtgccagcatcccatacaacgggcaaagctatccaggttccggctaa

SEQ ID NO: 257 - protein, 3063 aa, Homo sapiens
MRSRLPPALAALGAALLLSSIEAEVDPPSDLNFKIIDENTVHMSWAEPVDPIVGYRITVDPTTDGPTKEFTLSASTTETLLSELVPETEYVVTITSYDEVEESVPVIGQLTIQTGSSTKPVEKKPGKTEIQKCSVSAWTDLVFLVDGSWSVGRNNFKYILDFIAALVSAFDIGEEKTRVGVVQYSSDTRTEFNLNQYYQRDELLAAIKKIPYKGGNTMTGDAIDYLVKNTFTESAGARVGFPKVAIIITDGKSQDEVEIPARELRNVGVEVFSLGIKAADAKELKQIASTPSLNHVFNVANFDAIVDIQNEIISQVCSGVDEQLGELVSGEEVVEPPSNLIAMEVSSKYVKLNWNPSPSPVTGYKVILTPMTAGSRQHALSVGPQTTTLSVRDLSADTEYQISVSAMKGMTSSEPISIMEKTQPMKVQVECSRGVDIKADIVFLVDGSYSIGIANFVKVRAFLEVLVKSFEISPNRVQISLVQYSRDPHTEFTLKKFTKVEDIIEAINTFPYRGGSTNTGKAMTYVREKIFVPSKGSRSNVPKVMILITDGKSSDAFRDPAIKLRNSDVEIFAVGVKDAVRSELEAIASPPAETHVFTVEDFDAFQRISFELTQSICLRIEQELAAIKKKAYVPPKDLSFSEVTSYGFKTNWSPAGENVFSYHITYKEAAGDDEVTVVEPASSTSVVLSSLKPETLYLVNVTAEYEDGFSIPLAGEETTEEVKGAPRNLKVTDETTDSFKITWTQAPGRVLRCRIIYRPVAGGESREVTTPPNQRRRTLENLIPDTKYEVSVIPEYFSGPGTPLTGNAATEEVRGNPRDLRVSDPTTSTMKLSWSGAPGKVKQYLVTYTPVAGGETQEVTVRGDTTNTVLQGLKEGTQYALSVTALYASGAGDALFGEGTTLEERGSPQDLVTKDITDTSIGAYWTSAPGMVRGYRVSWKSLYDDVDTGEKNLPEDAIHTMIENLQPETKYRISVFATYSSGEGEPLTGDATTELSQDSKTLKVDEETENTMRVTWKPAPGKVVNYRVVYRPHGRGKQMVAKVPPTVTSTVLKRLQPQTTYDITVLPIYKMGEGKLRQGSGTTASRFKSPRNLKTSDPTMSSFRVTWEPAPGEVKGYKVTFHPTGDDRRLGELVVGPYDNTVVLEELRAGTTYKVNVFGMFDGGESSPLVGQEMTTLSDTTVMPILSSGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHDYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWGPFGSSDKMETILNGDENTLVFENLNPNTIYEVSITAIYADESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNRLGVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDSAMGPRGPPGRPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIQGPPGPPGYCDSSQCASIPYNGQSYPGSG

SEQ ID NO: 258 - DNA, 1717 bp, Homo sapiens
gtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggtaaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggc

SEQ ID NO: 259 - protein, 338 aa, Homo sapiens
MSLSAFTLFLALIGGTSGQYYDYDFPLSIYGQSSPNCAPECNCPESYPSAMYCDELKLKSVPMVPPGIKYLYLRNNQIDHIDEKAFENVTDLQWLILDHNLLENSKIKGRVFSKLKQLKKLHINHNNLTESVGPLPKSLEDLQLTHNKITKLGSFEGLVNLTFIHLQHNRLKEDAVSAAFKGLKSLEYLDLSFNQIARLPSGLPVSLLTLYLDNNKISNIPDEYFKRFNALQYLRLSHNELADSGIPGNSFNVSSLVELDLSYNKLKNIPTVNENLENYYLEVNQLEKFDIKSFCKILGPLSYSKIKHLRLDGNRISETSLPPDMYECLRVANEVTLN

SEQ ID NO: 260 - DNA, 6728 bp, Homo sapiens
agcagacgggagtttctcctcggggtcggagcaggaggcacgcggagtgtgaggccacgcatgagcggacgctaaccccctccccagccacaaagagtctacatgtctagggtctagacatgttcagctttgtggacctccggctcctgctcctcttagcggccaccgccctcctgacgcacggccaagaggaaggccaagtcgagggccaagacgaagacatcccaccaatcacctgcgtacagaacggcctcaggtaccatgaccgagacgtgtggaaacccgagccctgccggatctgcgtctgcgacaacggcaaggtgttgtgcgatgacgtgatctgtgacgagaccaagaactgccccggcgccgaagtccccgagggcgagtgctgtcccgtctgccccgacggctcagagtcacccaccgaccaagaaaccaccggcgtcgagggacccaagggagacactggcccccgaggcccaaggggacccgcaggcccccctggccgagatggcatccctggacagcctggacttcccggaccccccggaccccccggacctcccggaccccctggcctcggaggaaactttgctccccagctgtcttatggctatgatgagaaatcaaccggaggaatttccgtgcctggccccatgggtccctctggtcctcgtggtctccctggcccccctggtgcacctggtccccaaggcttccaaggtccccctggtgagcctggcgagcctggagcttcaggtcccatgggtccccgaggtcccccaggtccccctggaaagaatggagatgatggggaagctggaaaacctggtcgtcctggtgagcgtgggcctcctgggcctcagggtgctcgaggattgcccggaacagctggcctccctggaatgaagggacacagaggtttcagtggtttggatggtgccaagggagatgctggtcctgctggtcctaagggtgagcctggcagccctggtgaaaatggagctcctggtcagatgggcccccgtggcctgcctggtgagagaggtcgccctggagcccctggccctgctggtgctcgtggaaatgatggtgctactggtgctgccgggccccctggtcccaccggccccgctggtcctcctggcttccctggtgctgttggtgctaagggtgaagctggtccccaagggccccgaggctctgaaggtccccagggtgtgcgtggtgagcctggcccccctggccctgctggtgctgctggccctgctggaaaccctggtgctgatggacagcctggtgctaaaggtgccaatggtgctcctggtattgctggtgctcctggcttccctggtgcccgaggcccctctggaccccagggccccggcggccctcctggtcccaagggtaacagcggtgaacctggtgctcctggcagcaaaggagacactggtgctaagggagagcctggccctgttggtgttcaaggaccccctggccctgctggagaggaaggaaagcgaggagctcgaggtgaacccggacccactggcctgcccggaccccctggcgagcgtggtggacctggtagccgtggtttccctggcgcagatggtgttgctggtcccaagggtcccgctggtgaacgtggttctcctggccccgctggccccaaaggatctcctggtgaagctggtcgtcccggtgaagctggtctgcctggtgccaagggtctgactggaagccctggcagccctggtcctgatggcaaaactggcccccctggtcccgccggtcaagatggtcgccccggacccccaggcccacctggtgcccgtggtcaggctggtgtgatgggattccctggacctaaaggtgctgctggagagcccggcaaggctggagagcgaggtgttcccggaccccctggcgctgtcggtcctgctggcaaagatggagaggctggagctcagggaccccctggccctgctggtcccgctggcgagagaggtgaacaaggccctgctggctcccccggattccagggtctccctggtcctgctggtcctccaggtgaagcaggcaaacctggtgaacagggtgttcctggagaccttggcgcccctggcccctctggagcaagaggcgagagaggtttccctggcgagcgtggtgtgcaaggtccccctggtcctgctggaccccgaggggccaacggtgctcccggcaacgatggtgctaagggtgatgctggtgcccctggagctcccggtagccagggcgcccctggccttcagggaatgcctggtgaacgtggtgcagctggtcttccagggcctaagggtgacagaggtgatgctggtcccaaaggtgctgatggctctcctggcaaagatggcgtccgtggtctgaccggccccattggtcctcctggccctgctggtgcccctggtgacaagggtgaaagtggtcccagcggccctgctggtcccactggagctcgtggtgcccccggagaccgtggtgagcctggtccccccggccctgctggctttgctggcccccctggtgctgacggccaacctggtgctaaaggcgaacctggtgatgctggtgccaaaggcgatgctggtccccctgggcctgccggacccgctggaccccctggccccattggtaatgttggtgctcctggagccaaaggtgctcgcggcagcgctggtccccctggtgctactggtttccctggtgctgctggccgagtcggtcctcctggcccctctggaaatgctggaccccctggccctcctggtcctgctggcaaagaaggcggcaaaggtccccgtggtgagactggccctgctggacgtcctggtgaagttggtccccctggtccccctggccctgctggcgagaaaggatcccctggtgctgatggtcctgctggtgctcctggtactcccgggcctcaaggtattgctggacagcgtggtgtggtcggcctgcctggtcagagaggagagagaggcttccctggtcttcctggcccctctggtgaacctggcaaacaaggtccctctggagcaagtggtgaacgtggtccccccggtcccatgggcccccctggattggctggaccccctggtgaatctggacgtgagggggctcctgctgccgaaggttcccctggacgagacggttctcctggcgccaagggtgaccgtggtgagaccggccccgctggaccccctggtgctcctggtgctcctggtgcccctggccccgttggccctgctggcaagagtggtgatcgtggtgagactggtcctgctggtcccgccggtcccgtcggccccgtcggcgcccgtggccccgccggaccccaaggcccccgtggtgacaagggtgagacaggcgaacagggcgacagaggcataaagggtcaccgtggcttctctggcctccagggtccccctggccctcctggctctcctggtgaacaaggtccctctggagcctctggtcctgctggtccccgaggtccccctggctctgctggtgctcctggcaaagatggactcaacggtctccctggccccattgggccccctggtcctcgcggtcgcactggtgatgctggtcctgttggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggaagccgcaagaaccccgcccgcacctgccgtgacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaagaaggccctgctcctcaagggctccaacgagatcgagatccgcgccgagggcaacagccgcttcacctacagcgtcactgtcgatggctgcacgagtcacaccggagcctggggcaagacagtgattgaatacaaaaccaccaagtcctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaacccccccaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaaaaagaataaataaataagtttttaaaaaaggaagcttggtccacttgcttgaagacccatgcgggggtaagtccctttctgcccgttgggttatgaaaccccaatgctgccctttctgctcctttctccacaccccccttggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcatcccttgtgccgcaggctgggcgggagagactgttctgttctgttccttgtgtaactgtgttgctgaaagactacctcgttcttgtcttgatgtgtcaccggggcaactgcctgggggcggggatgggggcagggtggaagcggctccccatttttataccaaaggtgctacatctatgtgatgggtggggtggggagggaatcactggtgctatagaaattgagatgcccccccaggccagcaaatgttcctttttgttcaaagtctatttttattccttgatattttttctttctttttttttttttttgtggatggggacttgtgaatttttctaaaggtgctatttaacatgggaggagagcgtgtgcgctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccctaggggtgggaggaagcaaaagactctgtacctattttgtatgtgtataataatttgagatgtttttaattattttgattgctggaataaagcatgtggaaatgacccaaacataatccgcagtggcctcctaatttccttctttggagttgggggaggggtagacatggggaaggggccttggggtgatgggcttgccttccattcctgccctttccctccccactattctcttctagatccctccataaccccactcccctttctctcacccttcttataccgcaaacctttctacttcctctttcattttctattcttgcaatttccttgcaccttttccaaatcctcttctcccctgcaataccatacaggcaatccacgtgcacaacacacacacacactcttcacatctggggttgtccaaacctcatacccactccccttcaagcccatccactctccaccccctggatgccctgcacttggtggcggtgggatgctcatggatactgggagggtgaggggagtggaacccgtgaggaggacctgggggcctctccttgaactgacatgaagggtcatctggcctctgctcccttctcacccacgctgacctcctgccgaaggagcaacgcaacaggagaggggtctgctgagcctggcgagggtctgggagggaccaggaggaaggcgtgctccctgctcgctgtcctggccctgggggagtgagggagacagacacctgggagagctgtggggaaggcactcgcaccgtgctcttgggaaggaaggagacctggccctgctcaccacggactgggtgcctcgacctcctgaatccccagaacacaacccccctgggctggggtggtctggggaaccatcgtgcccccgcctcccgcctactcctttttaagctt

SEQ ID NO: 261 - protein, 1464 aa, Homo sapiens
MFSFVDLRLLLLLAATALLTHGQEEGQVEGQDEDIPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPGQPGLPGPPGPPGPPGPPGLGGNFAPQLSYGYDEKSTGGISVPGPMGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGAPGPAGARGNDGATGAAGPPGPTGPAGPPGFPGAVGAKGEAGPQGPRGSEGPQGVRGEPGPPGPAGAAGPAGNPGADGQPGAKGANGAPGIAGAPGFPGARGPSGPQGPGGPPGPKGNSGEPGAPGSKGDTGAKGEPGPVGVQGPPGPAGEEGKRGARGEPGPTGLPGPPGERGGPGSRGFPGADGVAGPKGPAGERGSPGPAGPKGSPGEAGRPGEAGLPGAKGLTGSPGSPGPDGKTGPPGPAGQDGRPGPPGPPGARGQAGVMGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGAPGAPGSQGAPGLQGMPGERGAAGLPGPKGDRGDAGPKGADGSPGKDGVRGLTGPIGPPGPAGAPGDKGESGPSGPAGPTGARGAPGDRGEPGPPGPAGFAGPPGADGQPGAKGEPGDAGAKGDAGPPGPAGPAGPPGPIGNVGAPGAKGARGSAGPPGATGFPGAAGRVGPPGPSGNAGPPGPPGPAGKEGGKGPRGETGPAGRPGEVGPPGPPGPAGEKGSPGADGPAGAPGTPGPQGIAGQRGVVGLPGQRGERGFPGLPGPSGEPGKQGPSGASGERGPPGPMGPPGLAGPPGESGREGAPAAEGSPGRDGSPGAKGDRGETGPAGPPGAPGAPGAPGPVGPAGKSGDRGETGPAGPAGPVGPVGARGPAGPQGPRGDKGETGEQGDRGIKGHRGFSGLQGPPGPPGSPGEQGPSGASGPAGPRGPPGSAGAPGKDGLNGLPGPIGPPGPRGRTGDAGPVGPPGPPGPPGPPGPPSAGFDFSFLPQPPQEKAHDGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYISKNPKDKRHVWFGESMTDGFQFEYGGQGSDPADVAIQLTFLRLMSTEASQNITYHCKNSVAYMDQQTGNLKKALLLKGSNEIEIRAEGNSRFTYSVTVDGCTSHTGAWGKTVIEYKTTKSSRLPIIDVAPLDVGAPDQEFGFDVGPVCFL

SEQ ID NO: 262 - DNA, 2574 bp, Homo sapiens
cctgtttagacacatggacaacaatcccagcgctacaaggcacacagtccgcttcttcgtcctcagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccgcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctgagaccccacgtgcgacagagagaggggagagagaaccaccactgcctgactgcccgctcctcgggaaacacacaagcaacaaacctcactgagaggcctggagcccacaaccttcggctccgggcaaatggctgagatggaggtttccttttggaacatttctttcttgctggctctgagaatcacggtggtaaagaaagtgtgggtttggttagaggaaggctgaactcttcagaacacacagactttctgtgacgcagacagaggggatggggatagaggaaagggatggtaagttgagatgttgtgtggcaatgggatttgggctaccctaaagggagaaggaagggcagagaatggctgggtcagggccagactggaagacacttcagatctgaggttggatttgctcattgctgtaccacatctgctctagggaatctggattatgttatacaaggcaagcatttttttttttaaagacaggttacgaagacaaagtcccagaattgtatctcatactgtctgggattaagggcaaatctattacttttgcaaactgtcctctacatcaattaacatcgtgggtcactacagggagaaaatccaggtcatgcagttcctggcccatcaactgtattgggccttttggatatgctgaacgcagaagaaagggtggaaatcaaccctctcctgtctgccctctgggtccctcctctcacctctccctcgatcatatttccccttggacacttggttagacgccttccaggtcaggatgcacatttctggattgtggttccatgcagccttggggcattatgggtcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatattactctcaaaatctttgtataaataaatatttttggggcatcctggatgatttcatcttctggaatattgtttctagaacagtaaaagccttattctaaggtg

SEQ ID NO: 263 - protein, 412 aa, Homo sapiens
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 264 - DNA, 5086 bp, Homo sapiens; identical to SEQ ID NO: 213
  misc_feature (1)...(5086): n = A,T,C or G

SEQ ID NO: 265 - protein, 1366 aa, Homo sapiens; identical to SEQ ID NO: 214

SEQ ID NO: 266 - DNA, 2028 bp, Homo sapiens
atggcatatgcaaaagccctgaggctgcagtggagagagccattgaaagggaagggcaataaggagcggttcaagggagagtatcaactcacatgggccttgaaggccacgcactgcctagcagcaactcactggagcccctcttgccccccgcaacaggtgtttggggacctggaccaggtgaggatgacctcggagggctccgactgccgttgcaagtgcatcatgcggcccctgagcaaggacgcgtgtagccgagtgcgcagtgggcgggcacgcgtggaggacttctacacggtggagactgtgagctcgggcactgactgccgctgctcctgtaccgcacctccctcctctctcaacccctgtgagaacgagtggaagatggagaaactcaaaaagcaggcgcccgagctcctcaagctgcagtccatggtggatctcctggagggcaccctgtacagcatggacttgatgaaggtgcacgcctacgtccacaaggtggcctcccagatgaacacactggaagagagcatcaaggccaacctgagccgggagaatgaggtggtgaaggacagcgtgcgccacctcagtgagcagttgaggcactatgagaatcactctgccatcatgctgggcatcaagaaggagctgtcccgcctgggcctccagctgctgcagaaggatgccgccgccgcccctgccacccctgccacgggcactggtagcaaggcccaggacacagctagaggaaaaggcaaggacatcagcaagtatggcagtgtgcagaaaagctttgcagacagaggcctcccaaaacctcccaaggagaagctgcttcaggtggagaagctgagaaaggagagcggcaagggcagtttcctccagcccacagccaagccccgcgccctggcccagcagcaggctgtgatccggggcttcacctactacaaggcaggcaagcaggaggtgaccgaggcggtggcagacaacaccctccagggcacttcctggctggagcaactgccgcccaaggtggagggcaggtccaactccgcagagcccaactccgcagagcaggatgaggctgagcccaggtcctccgagcgagtggacctggcttctggcacccccacttcaatccctgccaccaccaccaccgccaccaccaccccaacccccaccaccagtctcctgcccaccgagccaccttcaggtccagaagtctccagccaaggcagagaggcgagctgtgagggcaccctccgggctgtggacccccctgtgaggcaccacagctatgggcgccacgagggagcctggatgaaggaccctgcagctcgagacgacaggatctatgtcaccaactactactatggaaacagcctggtggagttccgcaacctggaaaacttcaagcaaggccgctggagtaacatgtacaagctaccctacaactggatcggcacaggccacgtggtgtaccagggcgccttctactacaaccgcgccttcaccaagaacatcatcaagtacgacctacggcagcgcttcgtggcctcctgggcgctgctgcccgacgtggtatatgaggacaccacaccttggaagtggcgcggacactcggacattgactttgccgtggacgagagcggcctgtgggtcatctaccccgccgtggacgaccgcgatgaggcccagcccgaggtgatcgtcctgagtcgcttggaccccggcgatctctccgtgcaccgggagaccacgtggaagacacggctgcggcggaactcctacgggaactgcttcctggtgtgcggcatcctgtatgccgtggacacgtacaaccagcaggaaggccaggtcgcctacgctttcgacacgcacacgggcaccgacgcacgcccccagctgccgttcctcaacgagcacgcctacaccacccagatcgactacaaccccaaggagcgggtgctgtacgcctgggacaatggccaccagctcacctacaccctccacttcgtggtctga

SEQ ID NO: 267 - protein, 675 aa, Homo sapiens
MAYAKALRLQWREPLKGKGNKERFKGEYQLTWALKATHCLAATHWSPSCPPQQVFGDLDQVRMTSEGSDCRCKCIMRPLSKDACSRVRSGRARVEDFYTVETVSSGTDCRCSCTAPPSSLNPCENEWKMEKLKKQAPELLKLQSMVDLLEGTLYSMDLMKVHAYVHKVASQMNTLEESIKANLSRENEVVKDSVRHLSEQLRHYENHSAIMLGIKKELSRLGLQLLQKDAAAAPATPATGTGSKAQDTARGKGKDISKYGSVQKSFADRGLPKPPKEKLLQVEKLRKESGKGSFLQPTAKPRALAQQQAVIRGFTYYKAGKQEVTEAVADNTLQGTSWLEQLPPKVEGRSNSAEPNSAEQDEAEPRSSERVDLASGTPTSIPATTTTATTTPTPTTSLLPTEPPSGPEVSSQGREASCEGTLRAVDPPVRHHSYGRHEGAWMKDPAARDDRIYVTNYYYGNSLVEFRNLENFKQGRWSNMYKLPYNWIGTGHVVYQGAFYYNRAFTKNIIKYDLRQRFVASWALLPDVVYEDTTPWKWRGHSDIDFAVDESGLWVIYPAVDDRDEAQPEVIVLSRLDPGDLSVHRETTWKTRLRRNSYGNCFLVCGILYAVDTYNQQEGQVAYAFDTHTGTDARPQLPFLNEHAYTTQIDYNPKERVLYAWDNGHQLTYTLHFVV

SEQ ID NO: 268 - DNA, 1909 bp, Homo sapiens
gacaccttttaaaatgcagaactaactgaggcatttcagtaactttgctttcaaatcaataaagtcaaatgtatggaaacattttgtgccctactctccataccctgtgtactcaaattctctactgtatgaattatgctttaagtagaattcagtgccaaggagaacttggtgaaataaattattttaattttttttttatcctttacaaagccatggattttatttggttgatgtgtgctctgtacacaagccatttcaataggatggagctgttaattattttccaaagagtaatagacatgcaaaagtttcaataaaaactgggccattaacaaataaattaataaactaataagcattcccttctaggtttttgccaaactgcctatccaataacaaatttgagaatcgttgaaaaagctagttatatttcagagaaatgattttcattattgaaactgttctccctagcaggccattttccctttttcctgggagtttagcaagtttaggagagaatagtcatgaaaagaaagggaagaaaggggagaagggaagaggttaaaaagtaagtgctcagacctatgaacgtaatccctttgctagaaatatttaagagcagctcagcttggttgaaactgagttttgtcatcttccatatttgcaggaaggtattttctgacttgcaatgcagctagatgtaaaattttattttatcatcctagaaagccttgactagaaaaatgaataaatattgagggtttcctgtccatatctggcttgcatgtgccagaaagcagagaatagaaaatgtaatctccaacatccaagcatcgaaacccaaggggtaggcaattctatgtaggttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttaattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctattttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctatataacaaaaaaaaaaaaaaaaaa

SEQ ID NO: 269 - protein, 83 aa, Homo sapiens
MYGNILCPTLHTLCTQILYCMNYALSRIQCQGELGEINYFNFFFILYKAMDFIWLMCALYTSHFNRMELLIIFQRVIDMQKFQ

SEQ ID NO: 270 - DNA, 1720 bp, Homo sapiens
gactgcagatgaaattagtaactggtggggtcgtggggtgtgaatggtgggcgggagcagctatgtcagttggtgtgtttctgcttatgttagggtaattgggcacggcctttgtgtaactggtgaatatctctgaacctgggcatgaaacagagagatgtcctaactctgggtgagaggaatcctcatttttctctgccctctcactgtggcatcctaagaaaaaagttttgggttcctgcagcatgaaggagagctctgctcccagaatttgggagctccagatttcttccagggtgtggaggcatcaatatatcagtctgggaaaggggttcctgggccactccaggagctgagttgggtggaaggtgctgagagtgtgggtgggggccacttctgagcacccatgtggcacccactgctggtccctgtttgtggctgggcactcaggaaaatgtttttggtgctaagagtaaaaagccaaccaacaaacacatctcttttttctgtctattcactggaaagtaaaagcagtctgggcgcaggctggggacccagatggaattcaaacttatgcctgctctcaaggtgctcacggttgctgataaacagctggataaaatgaagagtctatgagtgagggatgcagagccagggaaggctggtggagtgatgccaccagcacaggggtatgagtttgcagctgccaaggggccaagggatgagctggggccctccttcccaatggcatctccccctggtctggaactgaagacactgagcaatggtccccaagccccaaggagatcagctcccctgggcccagtggccccaaccagggagggtgtggagaatgcctgcttctcctcagaggagcatgagacccatttccagaaccctgggaacacgagactgggcagctcacccagtccccctgggggtgtctcctcactgccccgatcccagcgggatgatctgtcccttcattcagaggaggggccagccctggagcccgtgagccgcccggtggattatggctttgtttccgccctcgttttcctggtgagtgggattcttctggtggtgacagcatacgccatcccccgtgaggctcgagtcaatccggacacagtgacagcgcgggagatggaacgactggagatgtactacgcccgcctaggctcccacctggacaggtgcatcatcgcaggcctcgggctgctcacggtgggcggcatgctcttgtcggtgctgctcatggtctccctgtgcaagggcgagctgtaccgccggaggaccttcgtccccggcaagggctccaggaagacctacggctccattaacctgcgcatgagacagctcaatggggatgggggccaggccctggtggagaatgaagttgtccaggtctcagagactagccacaccctccagaggtcttaagaactagcccaccttatctggctgctttagctccagtgctacaaggtccaccccctgctcccgcccacctgacccctgccaaggccctggggttttaaactgagctcacatagggccttgtggaagaagtactgggtgctggagggagagctcggggcccagcccatgccccacacgggcaagcagcccactgatctgttttgtagctgaggttttgcatacggttttgtttggaggatggcttctgctgctaaaaatacaaaagtttggaaaccgc

SEQ ID NO: 271 - protein, 256 aa, Homo sapiens
MPPAQGYEFAAAKGPRDELGPSFPMASPPGLELKTLSNGPQAPRRSAPLGPVAPTREGVENACFSSEEHETHFQNPGNTRLGSSPSPPGGVSSLPRSQRDDLSLHSEEGPALEPVSRPVDYGFVSALVFLVSGILLVVTAYAIPREARVNPDTVTAREMERLEMYYARLGSHLDRCIIAGLGLLTVGGMLLSVLLMVSLCKGELYRRRTFVPGKGSRKTYGSINLRMRQLNGDGGQALVENEVVQVSETSHTLQRS

SEQ ID NO: 272 - DNA, 1111 bp, Homo sapiens
ccgcgcgctcgccccgccgctcctgctgcagccccaggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatacgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagctaaaaaaa

SEQ ID NO: 273 - protein, 284 aa, Homo sapiens
MDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEDELYAQKLKYKAISEELDHALNDMTSI

SEQ ID NO: 274 - DNA, 2032 bp, Homo sapiens
caccccgcagcccggcctcggcctccgccgcttgttgtcgcgccccgcccgcgagcccgccccgcacgtcccccgccggcggccaccatgagcacaggcctgcggtacaagagcaagctggcgaccccagaggacaagcaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtc

SEQ ID NO: 275 - protein, 369 aa, Homo sapiens
MSTGLRYKSKLATPEDKQDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEVENQAHCDFVKLRNMLIRTHMHDLKDVTCDVHYENYRAHCIQQMTSKLTQDSRMESPIPILPLPTPDAETEKLIRMKDEELRRMQEMLQRMKQQMQDQ

SEQ ID NO: 276 - DNA, 1344 bp, Homo sapiens
tgcagactgatatggattcaccactgctaacacctcctggttggaactacaggaatagaactggaaagggaaaaaaggcagcattcaccacatcccaatcctgaatccaagagtctaagatagtcccccactcctatctcaggcttagaggattagattaatctcctggagggaagactcttccttgaaacatttttttttatctgcctgtagctattgggataattcgggaaatccacagggacagttcaagtcatctttgtcctctactttctgttgcactctcagccttgttctctttttagaaactgcatggtaactattatatagctaaagaagagcattctgacctctgccctgggacttcctggatcctcctcttcttataaatacaagggcagagctggtatcccggggagccaggaagcagtgagcccaggagtcctcggccagccctgcctgcccaccaggaggatgaaggtctccgtggctgccctctcctgcctcatgcttgttgctgtccttggatcccaggcccagttcacaaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgagcctctgaagctcccaccaggccagctctcctcccacaacagcttcccacagcatgaagatctccgtggctgccattcccttcttcctcctcatcaccatcgccctagggaccaagactgaatcctcctcacggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttc

SEQ ID NO: 277 - protein, 93 aa, Homo sapiens
MKISVAAIPFFLLITIALGTKTESSSRGPYHPSECCFTYTTYKIPRQRIMDYYETNSQCSKPGIVFITKRGHSVCTNPSDKWVQDYIKDMKEN

SEQ ID NO: 278 - DNA, 1344 bp, Homo sapiens; identical to SEQ ID NO: 276

SEQ ID NO: 279 - protein, 93 aa, Homo sapiens; identical to SEQ ID NO: 277

SEQ ID NO: 280 - DNA, 1344 bp, Homo sapiens; identical to SEQ ID NO: 276

SEQ ID NO: 281 - protein, 93 aa, Homo sapiens; identical to SEQ ID NO: 277

SEQ ID NO: 282 - DNA, 2750 bp, Homo sapiens
tacgatggcaacacctcccgcaaggcccccaatgagttcctgacctcggtggtggagctcatcggcgccgccaaggccctgctggcgtggctggaccgattgctattttatgtgtcacttgagagaaaacagttaaataaaaactaatttaatacaaaatttagctgggcttggtggcacatgcctgtaatcccagctactcgggaggctgaagcaggagagttgcttgaacctgggaggcgtagattgcagtgagccaagatcatcccactgcactccagcctgggcgacagagtgagacacagtctcaaacaaaacaaaacaaaaaggaatttagagtagcccatggggtagctatgcttaccaacatccagtgggatccccgtggattctccctacccctttttaagaggattgttgctaccttctagggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaattctcctgcagacagatctcagaagattcatgctggtgacgaagtcattcaagttaatcagcaaactgtggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatgrcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcggcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactatctaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttactcttaaaaaaaaaaaaaaaaa

SEQ ID NO: 283 - protein, 380 aa, Homo sapiens
  VARIANT (1)...(380): Xaa = Any Amino Acid
MEDKVLTVVKVLNGICDKTIRSTTDPVMSQCACLEEVHLPNIKPGEGLGMYIKSTYDGLHVITGTTENSPADRSQKIHAGDEVIQVNQQTVVGWQLKNLVKKLRENPTGVVLLLKKRPTGSFNFTPAPLKNLRWKPPLVQTSPPPATTQSPESTMDTSLKKEKSAILDLYIPPPPAVPYSPRDENGSFVYGGSSKCKQPLPGPKGSESPNSFLDQESRRRRFTIADSDQLPGYSVETNILPTKMREKTPSYXKPRPLSMPADGNWMGIVDPFARPRGHGRKGEDALCRYFSNERIPPIIEESSSPPYRFSRPTTERHLVRGADYIRGSRCYINSDLHSSATIPFQEEGTKKKSGSSATKSSSTEPSLLVSWFTRLKLLTH

SEQ ID NO: 284 - DNA, 1789 bp, Homo sapiens
ggttcaggaacctgctggttctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatgagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcagaaacaaaaccatgggcagtgtatgctgggctgttagggggtgtcatcatgattctcatcatggtggtaatactacagttgagaagaagaggtaaaacgaaccattaccagacaacagtggaaaaaaaaagccttacgatctatgcccaagtccagaaaccaggtcctcttcagaagaaacttgactccttcccagctcaggacccttgcaccaccatatatgttgctgccacagagcctgtcccagagtctgtccaggaaacaaattccatcacagtctatgctagtgtgacacttccagagagctgacaccagagaccaacaaagggactttctgaaggaaaatggaaaaaccaaaatgaacactgaacttggccacaggcccaagtttcctctggcagacatgctgcacgtctgtacccttctcagatcaactccctggtgatgtttcttccacatacatctgtgaaatgaacaaggaagtgaggcttcccaagaatttagcttgctgtgcagtggctgcaggcgcagaacagagcgttacttgataacagcgttccatctttgtgttgtagcagatgaaatggacagtaatgtgagttcagactttgggcatcttgctcttggctggaactgataataaaaatcagactgaaagccaggacatctgagtacctatctcacacactgaccaccagtcacaaagtctggaaaagtttacattttggctatctttactttgttctgggagctgatcatgataacctgcagacctgatcaagcctctgtgcctcagtttctctctcaggataaagagtgaatagaggccgaagggtgaatttcttattatacataaaacactctgatattattgtataaaggaagctaagaatattattttatttgcaaaacccagaagctaaaaagtcaataaacagaaagaatgattttgagaaa

SEQ ID NO: 285 - protein, 335 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRGKTNHYQTTVEKKSLTIYAQVQKPGPLQKKLDSFPAQDPCTTIYVAATEPVPESVQETNSITVYASVTLPES

SEQ ID NO: 286 - protein, 305 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSGKTNHYQTTVEKKSLTIYAQVQKPGPLQKKLDSFPAQDPCTTIYVAATEPVPESVQETNSITVYASVTLPES

SEQ ID NO: 287 - protein, 298 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRGKTNHYQTTVEKKSLTIYAQVQKPGDTHHQTSDLF

SEQ ID NO: 288 - DNA, 3640 bp, Homo sapiens
aggacgggacggagccggggcagccagaagaggtgggaaaagcggaggaggacgcccaggaggaggcggcggcggcggccgggaagtgaaaggtctcgcaaagttcagcggcggctgcgggcgccgagccccgggctagcggcagacgagcccgcagggccgctccgcggggcagcgcagccaggccggctatggtcccggggctcccgccgccccccaggtgcccgggacccgccaggccggtgcgcgagggtcaccccacctccccgcgcggtcccggcccctggctcccagctgccggcgaccgctgaccgagcccggcgccccaggaggaggaagaaaccagggccccgttccctcccgaggacggcggcgcttcatcccgcagcccagaggtctcggctccctccggcacccgcccggcccggctgctcccggctcctcccggccatggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagaacctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaacttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtacctctaacaaggacgccttccagcttcagcgatgttacttacgtttgatgctacttaaagtaatgaatgacgttttaaggaatccctaaccctactatcagaaaaggtgtttgttaaagagccttctcttgtgtgttacgcatgaactttggtctgtaggtgttaaatggaacctctccatgtgtatatagtatttccttgtataaagcactttactacctaccacttgtgttgtgaacgtttggtgactgctgttgaaagaaggaaaagggtgtgtgagaaagcctactgaagcagcagcactgccactacatgtggacaaaagtgaccatataaaagaagttgtgctatttaactctgaatacttggagaaactaggtgaagatgcaaccagaaaggagaatatgtatgcgtgaagtctcagctttgagctggaggctagattccaagatgacagccatgatgaaactttttaaaaaactaaaccagaagagactttaaaataagagaaagaaatcataaatgtagacatatgcttggctaaaggggaaatggactttaaattttaaagagctcatttgcaatgcacttgtatacacttcaaaaattattgtagacacagaatttgttatatttttgtgcttagtatttaaacctgaacattgaaacagttttcctccttgtctttcttaacagtaatagtcattatatttacctgttttttaacacaatgtatgtgatagtcaaaaaatcacagtttttcattattattcatcttctgtacccacgcataaccactatacatagtttcttttgtacttgaatatacaaaacatgaacacagtgccatatgaataatttcacatacagaacctttttttctctgaagtcctgtggacttgcaaatatatatatatattgctttgttaatttgtttttatatttcatatatgtaataaaggaatatgatctgaaaaaaaaaaaaaaaaaaaaaaaaa

SEQ ID NO: 289 - protein, 628 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 290 - DNA, 2540 bp, Mouse
gtcgcgatgctgctgcgcctgctgctggcctgggtggccgcggtgcccgcactgggccaggtcccctggacgccggagcctcgagccgcgtgcggccccagcagctgctacgcgctctttccccggcgccgcacattcctggaagcttggcgggcgtgccgcgaattggggggcaacctggccacaccgcggaccccagaggaggcccagcgtgtggacagcctggtgggggtcgggccggccaacgggctgctatggattgggttgcagcggcaggctaggcaatgccagccgcagcgcccactgcggggcttcatatggaccacgggagaccaggacaccgccttcaccaactgggcccagccggctacggaaggaccctgcccagcccagcgctgtgcagcccttgaggccagcggagagcatcgctggctcgaaggctcgtgcacactggctgtcgatggctacctctgccagtttggttttgagggtgcctgccctgccttgccgcttgaggtgggtcaggccggtcccgctgtctacaccacacccttcaacctggtttccagcgagttcgaatggctgccctttggctccgtggcagctgtgcagtgccaagctggcaggggagcttctctgctgtgcgtgaaacagccttcaggtggcgtgggctggtcccagactggcccgctgtgcccagggactggctgtggtcctgacaatgggggttgcgaacatgagtgtgtggaagaggtggacggtgctgtgtcctgccgctgcagtgaaggcttccgtctagcagcagatgggcacagttgtgaagacccctgtgcccaggccccctgtgagcagcagtgtgaacctggagggccacaaggctatagctgccactgtcgccttggcttccggccagctgaggatgatccacaccgctgcgtggacacggatgagtgccagattgctggtgtgtgccagcagatgtgtgtcaactatgttggtggctttgagtgttactgcagcgagggtcacgagcttgaggcagatggtatcagctgtagccctgcaggagccatgggtgcccaggcttcccaggatctcagagatgagttgctggatgatggagaagaaggggaggatgaagaggagccctgggaggactttgatggcacctggacagaggaacaggggatcctatggctggcacctacacatccacctgactttggcctgccctataggcccaacttcccacaggatggagagcctcagagattgcacctggagcctacctggccacccccacttagtgcccccaggggcccctaccactcctcagtggtgtctgccacacggcccatggtgatctctgccactcgacccacactaccttctgcccacaagacctctgttatttcagctacacgcccacccctgagccctgtccacccacctgccatggcccctgccacacctccagctgtgttctctgagcaccagatccccaaaatcaaggccaattatccagacctgccttttggccacaagcctgggataacctcggccactcacccagcacggtctcctccgtaccagccccccattatctcaaccaactatccccaagtcttccctccccaccaggcccctatgtctccagatacccacactatcacttatttgcctccagtcccccctcaccttgatcctggggataccacttctaaagcccatcaacaccctttgctcccagatgctccaggtatcagaacccaggccccccagctttctgtctcagctctccagccccctcttcctaccaactccaggtcttctgtccatgaaactcctgtgcctgctgccaaccagcccccagccttcccttcttctcccctcccccctcagaggcccactaaccagacctcatctatcagccctacacattcctattccagagcccctctagtcccaagggaaggagttcccagtcccaaatcagtgccacagctgccctcggtgccctccacagcagctccaacagccctggcagagtcaggtcttgcaggccaaagccaaagggatgaccgctggctgctggtggcactcctggtgccaacatgtgtcttcttggtggtgctgcttgccctgggcattgtgtactgcactcgctgtggctcccacgcacccaacaagcggatcacggactgctatcgctgggtcacacatgctgggaacaagagctcaacagaacccatgccccccagaggcagccttacaggggtacagacctgtagaaccagtgtgtgatggggtgcagatgcccctttgtgggatagaagaaaaggacttgctttggacacatggctgagaccacaccaaggacttatgggggctgcccagctgacagaggaggttctgttctttgagcccagcatccatggcaaaggacacaccaggactccaggacctcaaggggtgggtgctgggatcttctccaataaatggggtgccaacctcacccaaaaaaaaaaaaaaaaaaaaaa

SEQ ID NO: 291 - protein, 765 aa, Mouse; identical to SEQ ID NO: 190

SEQ ID NO: 292 - DNA, 3020 bp, Mouse
atgtttccttgctaccatggtttcctgaactcaagtggccagtgtgtggggcctctgagccacactctcttgcccacctctgccaccagtccacgaaggatgaggaagggtattggattgtcctggacctcctggaagctagactagggtctggagcaacgaccggctttggactctctgattcaggttcctcctaagcctcagagggacaaaaaagagtccctgcaagtcgtccacggggctgggagcagccgggtggctcatgactactcagagagtctgcccaaagaaaagagtcttgtattggaaaggtttctgggtacctgaccgtgttgcgtttgtttctacccaacgtttaacagagagcccagagccatgatgaagaccttgtccagtgggaactgcacactcaatgtgcctgctaagaactcctaccgcatggtggtgctgggtgcctcccgagtgggcaagagctccattgtctcccgcttcctcaatggccgctttgaggaccagtacacgcccactatcgaggactttcatcgcaaggtgtacaacatccacggggacatgtaccagctggatatcctggacacctctggcaaccacccattccctgccatgcgccggctctccatcctcacaggagatgtcttcatcctggtgttcagcctggatagccgggagtcctttgatgaggtcaagcgcctccagaaacagatcctggaggtcaagtcctgcctgaagaataaaaccaaggaggcagcagagctgcccatggtgatctgtgggaacaagaatgaccacagtgagctgtgccgccaggtccctgccatggaggctgagctgctggtgtctggtgatgaaaactgcgcctatttcgaggtgtcagccaagaagaacactaatgtgaacgagatgttctatgtgctgttcagcatggccaagctgccccatgagatgagccctgcactgcaccataagatctccgtgcagtacggcgatgcttttcacccccggcccttctgcatgcgtcgcactaaggtcgcaggtgcctatggcatggtctcaccctttgcccgacgccccagtgtcaacagtgacctcaagtacatcaaggccaaggtcctacgggagggccaggcccgagagagggacaagtgtagcatccagtgagaggcagggacatcggggagggggcttgggcagtgccttaagggaggtggctgaggattcccactgcgcacatcccacagagggccctaggtgtgtaccctgtgcccattctcttgtttcctggacacctcctgtgagccgtgagtgtggttcctttgtgggaggacggagacatgtctagggacatgacagcactcatgccgagacaagctttccgtgggagggatgcaaaaaggccaggagtcctgcatcaaagcaagatgctcagtacaagtcacaggatgagaacatcttagccagatgccccagccaggttccctggtggcctctgctccctctgttcagaccagcttggtctcagtgtccctggagaaaccaccatcttgggtcttcagctcctgccgtctggcccagctgtgtacactgccccccaatttagcccctggggccatcatgaccttgagtggaggggagagagagagagagagagagagagagagagagagagagagagagagagacctgtgtcccccagatcactgccttttggctccactcccaggctcctccatacgatatttctctttgttttgaagtgtctttcctgttctgtttgcagtagacatgaagtccttgtactgtaagaggccaatgctttgtctttgaccgggcttcccaattcaaatccattgctttggccggggtctccctccctgctcccaggcaggctgtattctgcccagtgtccatcggcctacaaagagcccacagtgccacagtcacagcagtaatctcctgccctctggagaggatgactgggctttgagagagtgattctaaccccctccgcactcctaactagttcaggacagagctctgactagatgcagctttcttctgctttagttccttaaacatctgccaagcacctacctgatactggtcccttgtgtgctaggcaacagagagcgaggggtcctgtgtgtccccagctccggcctctgccctcccatggtgccctttctgcgcacacagctgttggaggaagtggagcagttgagagccagagccgagtccaggaaaggttggaaggacatattgcaggacttaccctagtgttcaggctatgctaggtacacaggagtgggggtgaccctgaaaaccaaaggtcctgttcaccacctcttaatgcatctgtgctttagtcttattagtactgcagctggcccatttgagatgactctggataaagacacctgctgccaagctttcaacctgagtttggtcccagggttccatgtggtggaaggagagaagtcatccattgacctccacacatccatcatggtacccctacccccccccccccccatgaattattgaagctgatgattatcagaaaccacagcaatctaatagtgcattctctcaaggcccaggtcactccctgcaagctgggtcggccatgggccttccatacacaccacgtcataccctgtctccttggagctcccagtagccgggatttggatcatgttacatatgccttcctcagagcaatcactgaggctatctgtggatactgtgcacattgtcacccttgctctgcacaccaggcccagcccagactccatacacacacctgctgctcagcacaattgcttcagcacctgcttctgtcctacaatgactccagccccagtcctgagtataccaggtacttgtccaggcaagtctatggcctggtccatccggtcaagctctactgcctggacctctgtgtacactatcaattaaagttggtttgttagctgtgaaaaaaaaaaaaaaaaaaaaaaaaaaaa

SEQ ID NO: 293 - protein, 266 aa, Mouse
MMKTLSSGNCTLNVPAKNSYRMVVLGASRVGKSSIVSRFLNGRFEDQYTPTIEDFHRKVYNIHGDMYQLDILDTSGNHPFPAMRRLSILTGDVFILVFSLDSRESFDEVKRLQKQILEVKSCLKNKTKEAAELPMVICGNKNDHSELCRQVPAMEAELLVSGDENCAYFEVSAKKNTNVNEMFYVLFSMAKLPHEMSPALHHKISVQYGDAFHPRPFCMRRTKVAGAYGMVSPFARRPSVNSDLKYIKAKVLREGQARERDKCSIQ

SEQ ID NO: 294 - DNA, 5520 bp, Mouse; identical to SEQ ID NO: 183

SEQ ID NO: 295 - protein, 1329 aa, Mouse; identical to SEQ ID NO: 191

SEQ ID NO: 296 - DNA, 2840 bp, Mouse
cggggctgctccctctgcagccgccgccgccgccgcgcagacccggaggtcgtccgcgcccaccatgcgagctcagctctggttgctgcagttgctgctactccgcggggccgcgcgcgcgctcagtcccgcaacacccgcaggtcacaatgaaggtcaagactctgcatggactgccaagaggaccaggcaaggctggagtcggagaccccgagagagccccgcgcaggtgttgaagccaggcaagacccagctaagccaggacttgggtgggggctccctggccatcgacacacttccggacaacaggactcgggtggtggaggacaaccataactactacgtgtcccgtgtctacggccctggtgagaaacaaagccaggatctgtgggtggacctggctgtggccaaccggagtcatgtgaagatccacaggatcctctccagttctcaccgacaggcttcaagagtggtcttgtcctttgatttccctttctatgggcatcctctgcggcagatcaccatagcaaccggaggcttcatcttcatgggggacatgctccaccggatgctcacagctacgcagtatgtggcacccctgatggccaacttcaaccccggctactctgacaactccacggttgcttactttgacaatgggaccgtttttgtggttcagtgggatcatgtttacctccaggaccgggaggacaggggcagcttcaccttccaggcggccctacaccgagatggccgcattgtcttcggctacaaagagatccccatggctgtcctggatatcagctctgcccagcaccctgtcaaggcaggcctgtccgacgctttcatgattctcaattcatccccagaggtgccagagtctcagagacggaccattttcgaataccaccgtgtggaactggactccagcaagatcaccaccacctcggccgtggagttcaccccgttgccaacctgcctccagcatcagagttgcgacacctgcgtgtcctcgaatctaaccttcaactgcagctggtgccatgtcctgcagaggtgttccagtggctttgaccgataccgccaagaatggctgacctacggctgtgcccaggaggcagaaggcaagacatgcgaggacttccaggatgatagccactactcagcctcccctgacagctccttcagcccctttaatggcgactccactacctcttcctccctcttcattgacagcctcaccacagaagatgacaccaagttgaatccctacgcagaaggagacggccttccggaccactcatctccgaagtccaagggtcctcccgtgcacctgggcaccatcgtgggtatcgtgcttgctgtactcctggtagcggccatcatcctggctgggatttacatcagtggccaccctaattccaatgctgcactcttcttcatcgagcggagacctcaccactggccagccatgaagttccataaccaccccaaccactctacctacaccgaggtagagccctccgggcacgagaaggaaggcttcgtggaggccgagcagtgctgagagagcatcgggccagagacctggagatggcatgaaagacaagtcacagcacagagaagtgattttttttcctggcttcctcggagctggccctgggccaggaagacaagacaacagcttgtggtgccaacactacagtttggtctgcacaccccatttaaagggggctcagtaatacaactgcgaaggctccttggggaacactgacctcaagagttccctgtttcaatgggaggaggcttcgtttggggtctctcagtggtctgcagctatggcggagcccctgcccactggagacagcctcctgtgttcctcctgctcactgaagcccacactgggccattgcattccggggtctatagattcaagagctggtcttgctagctatggagtcagtgcccttggctccaaactttgtggcttagaagcctgaagaaggggatcccttccctccgagagcgcttaaccctgagatgcgctaacagagagaaaagtaaccttggggaacttgcatttttctggccttggtcctttgcttcattgttttttttgcagaggccggggccaacatccgagcactgtagcctgcagctcattctgtaccctgccctgccctgcccctcagcctccaccctgcaagctggtcttgcatggctgccagtaatgagtggggcccttactgtgccatgtgtctggtgcctgcattactcgttaacctgttctgttatcaacggcagtagtttccttcaaagagggggacaatttacctggctcctgttttaacttggctgaccagagtcgagttcttgtaaccattaaaaacaactagggggccgggtgtggtggtgctcacactcaggaggctgagctctgagatcaaggccagcctggtctacagagagagcctgtcttgaagaaacaagacaaatggggggctagaggtttccctgagacacccctgccttagcaaggggctccagttggatcccgttgaagcacggtggccgcgaaggtagggcagagaaatctggtatgggagggagagaccttgacctggaaagcggcctccatctctccagctctgcaaagagctttgggaactgggagttgacgttcccacactcagcctggttttaagggacttctgtccccgtggtggaccaggacggcttctaaaggacaatgaaaacctagagctcaccttcatcccaaagaagcgtcatcagcaaataaataaggtatagccctcaaaaaaaaaaaaaaaaaaaaaaaa

SEQ ID NO: 297 - protein, 500 aa, Mouse; identical to SEQ ID NO: 192

SEQ ID NO: 298 - DNA, 2010 bp, Mouse
gagagaggtcgcggcagcggcatggcaaggttccggagggccgacctggccgcagcaggagttatgttactttgtcactttttaacagaccggttccacttcgcccacggggagcctggacaccataccaatgattggatttatgaagttacaaacgcttttccttggaatgaagagggggtagaagtggactctcaagcatacaaccacaggtggaaaagaaatgtggacccttttaaggcagtagacacaaacagagccagcatgggccaagcctctccagagtccaaagggttcactgacctgctactggatgacggacaggacaataacacccagatagaggaggacacggatcacaattactacatttctcggatatatggtccagcggattctgccagccgggatctgtgggttaacatagaccaaatggaaaaagacaaagtgaagattcacgggatactttccaacactcatcggcaagctgcaagagtgaatctgtccttcgattttccattttatggtcattttctaaatgaagtcactgtggcaactgggggtttcatatatactggagaagttgtacatcgaatgctcacagctacacagtatatagctcctttaatggcaaattttgatcccagtgtatccagaaattcaactgtcagatattttgataatggcacagctcttgttgtccagtgggaccatgtccacctgcaggataattacaacctgggaagcttcacattccaggccacactcctcatggacgggcgcatcatctttggatacaaagaaatccctgtcttggtcacacagataagttctaccaaccatccagtgaaagtcgggttgtctgatgcatttgtcgtggtccacaggatccagcaaatacccaatgttcgaagaagaacaatttatgaatatcaccgagtagaactacaaatgtccaaaattaccaacatctcagctgtggagatgactccacttcccacatgtctccagttcaatggttgtggcccttgtgtgtcctcgcagattggtttcaactgcagttggtgcagcaaacttcaaagatgctccagtggatttgatcgccatcggcaggactgggtggacagtggatgcccggaagaggtacagtcaaaagagaagatgtgtgagaagacagagccaggagagacgtctcaaactaccacgacctcccacacgaccaccatgcaattcagggtcctgaccaccaccaggagagctgtgacatcgcagatgcctaccagcctgcctacagaagatgacacgaagatagccctacatctcaaagacagtggagcctccacagatgacagtgcagctgagaagaaaggaggaaccctccatgcaggcctcattgttggaattctcatcttggtcctcattatagcagcggccattctggtgacagtgtatatgtatcaccatccaacatcagcagccagcatcttcttcattgagagacgcccaagcagatggccagcaatgaagtttcgaagaggctcaggacaccctgcctatgcagaagttgaaccagttggagagaaagaaggttttattgtatcagagcagtgctaaaattttaggacagagcagcaccagtactggcttacaggtgttaagactaaaactttgcttatgcatttaagacaaacagacacacaacccacaaccacacacaaaggagccctaaactgctgtagacagaagggcgacgagatttctggacaagcccagcccaggaacattgaaaggaaaactcagacttgtacaagacaccatgtacaatgattaaagaattccctagtggaatgacatccatggttcacaaggaacatctccggtggacttgccaggagtgtgacgagatgacgatgcttttggtttaggtgcagggttgcaaagaaatcaaggaaaaaaaatatgacaataaataaagctttagttcacaagggaaaaaaaaaaaaaaaaaaa

SEQ ID NO: 299 - protein, 530 aa, Mouse; identical to SEQ ID NO: 193

SEQ ID NO: 300 - DNA, 5220 bp, Mouse; identical to SEQ ID NO: 186

SEQ ID NO: 301 - protein, 562 aa, Mouse; identical to SEQ ID NO: 194

SEQ ID NO: 302 - DNA, 2690 bp, Mouse
agctttccccaccacagaatccaagtcggaactcttggcaccatgaacccagccatcagcgtcgctctcctgctctcaggtactgggcaagggtcagggctggcattctaaggaatctggcttcctcccatcccgggaagtagcctctttgccatagtctcaggggcacaggtggttgggaggtgcgggggtggggagtggggaggagcctcaacctcaccagtggtggtctttgacatattagaaactccataatggatctaggaactcctctgctgggtggtggtggttgtggtacacacctttaatctcagcactcaggaggcagagtcaggtggatctgttagtctgaagccagctggtctacagagcaaattccaggacagccagagctattctcaagatagagaatccctttcttgaaaaaaccatttaaaaacaaaaacaaaagcaacacactcctttgatctcctgttcttgaaacacattgttgggacccagaacttcagtagattgatggaagttggagtctgcaagtggtggaacatcccaccaatacctcaagggcgagtgcaaaccccacatccccccagctcaagctcacttttcctgcaggtgggaggcccgggtctgtgtctccccaaattcagagaaggcactgctgtgcagtcttgcaggtgtcccgagggcagaaggtgaccagcctgacagcctgcctggtgaaccaaaaccttcgcctggactgccgccatgagaataacaccaaggataactccatccagcatgagttcagcctgacccgagagaagaggaagcacgtgctctcaggcacccttgggatacccgagcacacgtaccgctcccgcgtcaccctctccaaccagccctatatcaaggtccttaccctagccaacttcaccaccaaggatgagggcgactacttttgtgagcttcaagtctcgggcgcgaatcccatgagctccaataaaagtatcagtgtgtatagaggtgagactggttcccagaaagataaaatgtctaggttagctaggctggggtagccaataaaaaaaaaaaaaaaaaaaaaaaaaaaaacaggcacctccattacccttcccctaactgctggtctcctgggaaactgctgctgtctatgtgagtggggcaagattaggggccagaaagggggagcttgtagtaaaagcacagttgaggaaactaaatgggaaaggcagtacagtggtgattcttgtggtgtggaggttctgttacagcatccggtggagccgctaagatgagaaagcgccagctagctgccttgaacagctgacacctgtctttgcccgcctgagtcctgatctcccctcctcccggcaccccttctctatccacagacaagctggtcaagtgtggcggcataagcctgctggttcagaacacatcctggatgctgctgctgctgctttccctctccctcctccaagccctggacttcatttctctgtgactggttgggcccaaggagaaacaggggccctcgaggagcccctcgggtccttcctctgcagaggtcttgcttctcccggtcagctgactccctccccaagtccttccaatatctcagaacatggggagaaacggggaccttgtccctcctaaggaaccccagtgctgcatgccatcatcccccccaccctcgcccccacccccgccacttctccctccatgcataccactagctgtcattttgtactctgtatttattctagggctgcttctgattatttagtttgttctttccctggagacctgttagaacataagggcgtatggtgggtaggggaggcaggatatcagtccctggggcgagttcctccctgccaaggaagccagatgcctgaaagagatatggatgagggaagttggactgtgcctgtacctggtacagtcatactctgtggggaatcatcggggagggggggggggctcaagatgggagagctctgctagcctttgtggaccatccaatgaggatgagggcttagattctaccaggtcattctcagccaccacacacaagcgctctgccatcactgaagaagccccctagggccttgggccagggcacactcagtaaagatgcaggttcagtcagggaatgatggggaaaggggtaggaggtgggggagggatcaccccctcctctaaaacacgagcctgctgtctccaaaggcctctgcctgtagtgagggtggcagaagaagacaaggagccagaactctgactccaggatctaagtccgtgcaggaaggggatcctagaaccatccggttggacccagcttaccaagggagagcctttattcttctttccctctgcccctctgtgccagcccctcttgctgtccctgatccccagacagacgagagtcttgcaaacagcctgttccaagacctcctaatctcaggggcaggcggtggagctgagatccggcgtgcacactttttggttgatagctttcccaaggatcctctcccccactggcagctctgcctgtcccatcaccatgtataataccaccactgctacagcatctcaccgaggaaagaaaaatgcacaataaaaccaagcctctggagtgtgtcctggtgtctgtctcttctgtgtcctggcgtctgtctcttctgtgt

SEQ ID NO: 303 - protein, 162 aa, Mouse
MNPAISVALLLSVLQVSRGQKVTSLTACLVNQNLRLDCRHENNTKDNSIQHEFSLTREKRKHVLSGTLGIPEHTYRSRVTLSNQPYIKVLTLANFTTKDEGDYFCELQVSGANPMSSNKSISVYRDKLVKCGGISLLVQNTSWMLLLLLSLSLLQALDFISL

SEQ ID NO: 304 - DNA, 4588 bp, Mouse
tgcgatcccctcgccggcggtcatccgagcacagcgctagggctgtctctgcacgcagccctgccgtgcgccctccgtactctcgtcctccgagcgccgcagggatggtacccatccgacctgccctcgcgccctggcctcgtcacctgctgcgctgcgtcttgcttctcgggggactgcgtctcggccacccggcggactccgccgccgccctcctggagcctgatgtcttcctcatcttcagccaggggatgcagggctgtctggaggcccagggtgtgcaggtccgagtcaccccattctgcaatgccagtctccctgcccagcgctggaagtgggtctcccggaaccgactcttcaacctgggtgccacacagtgcctgggtacaggctggccagtcaccaacaccacagtttccttgggcatgtatgagtgtgacagagaggccttgagtcttcggatggcagtgtcgtacactaggggaccagttgtccctgcttctgggggctcgtgcaagcaatgcatccaagcctggcacctggagcgcggtgaccagacccgcagtggccattggaacatctatggcagtgaagaagacctatgtgctcgaccttactatgaggtctacaccatccagggaaactcacacggaaagccgtgcactatccccttcaaatacgacaaccagtggttccacggctgcaccagcactggcagagaagatgggcacctgtggtgtgccaccacccaggactacggcaaagatgagcgctggggcttctgccccatcaagagtaacgactgtgagaccttctgggacaaagaccagctgactgacagctgttaccagtttaacttccaatccacactgtcctggagggaggcctgggccagctgcgagcagcagggtgcagacttgctgagtatcacggagatccacgagcagacctacatcaacgggctcctcacgggctacagctccacgctatggattggccttaatgacctggataccagtggaggctggcagtggtcagacaactcacccctcaagtacctcaactgggagagtgatcagccggacaacccaggtgaggagaactgtggagtgatccggactgagtcctcaggcggctggcagaaccatgactgcagcatcgccctgccctatgtttgcaagaagaaacccaacgctacggtcgagcccatccagccagaccggtggaccaatgtcaaggtggaatgtgaccccagctggcagcccttccagggccactgctaccgcctgcaggccgagaagcgcagctggcaggagtccaagagggcgtgtctgcggggtgggggtgacctccttagcatccacagcatggctgagctggagttcatcaccaaacagatcaagcaagaggtggaggagctatggattggcctcaatgatttgaaactgcagatgaattttgagtggtccgacgggagcctcgtgagcttcacccactggcacccctttgagcccaacaactttcgtgacagcctggaggactgtgtcaccatctgggggccggaaggacgctggaacgacagtccctgtaaccagtccttgccatccatttgcaagaaggcaggccggctgagccagggcgctgcggaggaggaccacgactgccggaagggttggacgtggcatagcccatcctgctactggctgggagaggaccaagtgatctacagtgatgcccggcgcctgtgtactgaccatggctctcagctggtcaccatcaccaacaggtttgagcaggccttcgtcagcagcctcatctataactgggagggcgaatacttctggacagccctgcaagacctcaacagtactggctccttccgttggctcagtggggatgaagtcatatatacccattggaatcgagaccagcctgggtacagacgtggaggctgtgtggctctggccactggcagtgccatgggactgtgggaggtgaagaactgcacatcgttccgggctcgctacatctgccgacagagcctgggcacaccggtcacaccagagctgcctgggccagaccccacgcccagcctcactggctcctgtccccagggctgggtctcagaccccaaactccgacactgctataaggtgttcagctcagagcggctgcaggagaagaagagttggatccaggccctgggggtctgccgggagttgggggcccagctgctgagtctggccagctatgaggaggagcactttgtggcccacatgctcaacaagatctttggtgagtcagagcctgagagccatgagcagcactggttttggattggcctgaaccgcagagaccctagagagggtcacagctggcgctggagcgacggtctagggttttcctaccacaattttgcccggagccgacatgatgacgatgatatccgaggctgtgcagtgctggacctggcctccctgcagtgggtacccatgcagtgccagacgcagcttgactggatctgcaagatccctagaggtgtggatgtgcgggaaccagacattggtcgacaaggccgtctggagtgggtacgctttcaggaggccgagtacaagttttttgagcaccactcctcgtgggcgcaggcacagcgcatctgcacctggttccaggcagatctgacctccgttcacagccaagcagaactgggcttcctggggcaaaacctgcagaagctgtcctcagaccaggagcagcactggtggatcggcctgcacaccttggagagtgacggacgcttcaggtggacagatggttctattataaacttcatctcttgggcaccgggaaaacctagacccattggcaaggacaagaagtgtgtatacatgacagccagacaagaggactggggggaccagaggtgccatacggctttgccctacatctgtaagcgcagcaatagctctggagagactcagccccaagacttgccaccttcagccttaggaggctgcccctccggttggaaccagttcctcaataagtgtttccgaatccagggccaggacccccaggacagggtgaaatggtcagaggcacagttctcctgtgaacagcaagaagcccagctggtcaccattgcaaaccccttagagcaagcatttatcacagccagcctccccaacgtgacctttgacctttggattggcctgcatgcctctcagagggacttccagtggattgaacaagaacccctgctctataccaactgggcaccaggagagccctctggccccagccctgctcccagtggcaccaagccgaccagctgtgcggtgatcctgcacagcccctcagcccacttcactggccgctgggatgatcggagctgcacagaggagacgcatggcttcatctgccagaagggcacagacccctcgctaagcccatccccagcagcaacaccccctgccccgggcgctgagctctcctatctcaaccacaccttccggctgctgcagaagccactgcgctggaaagatgctctcctgctgtgtgagagccgaaatgccagcctggcacacgtgcccgatccctacacacaagccttcctcacacaggctgcacgggggctgcaaacaccactgtggatcgggctggccagtgaggagggctcacggaggtattcctggctctcagaggagcctctgaattatgtgagctggcaagatgaggagccccagcactcgggaggctgtgcctacgtggatgtggatggaacctggcgcaccaccagctgtgataccaagctgcagggggcagtgtgtggggtgagcagggggcccccaccccgaaggataaactaccgtggcagctgtcctcagggcttggctgactcgtcctggattcccttcagggagcattgctattctttccacatggaggtgctgttgggccacaaggaggcgctgcagcgctgtcagaaagctggtgggacggttctgtccattcttgatgagatggagaatgtgtttgtctgggagcacctgcagacagctgaagcccaaagtcgaggtgcctggttgggcatgaacttcaaccccaaaggaggcacgctggtctggcaagacaacacagctgtgaactattctaactgggggccccctggcctgggccctagcatgctaagccacaacagctgctactggatccagagcagcagcggactgtggcgccccggggcttgtaccaacatcaccatgggagttgtctgcaagctccctagagtggaagagaacagcttcttgccatcagcagccctccccgagagcccggttgccctggtggtggtgctgacagcggtgctgctcctcctggccttgatgacggcagccctcatcctctaccggcgccgacagagtgcggagcgtgggtccttcgagggggcccgctacagtcgcagcagccactctggccccgcagaggccaccgagaagaacattctggtgtctgacatggaaatgaacgaacagcaagaatagagccaagggcgtggtcggggtggagccaaagcgggggaggcagg

SEQ ID NO: 305 - protein, 1479 aa, Mouse
MVPIRPALAPWPRHLLRCVLLLGGLRLGHPADSAAALLEPDVFLIFSQGMQGCLEAQGVQVRVTPFCNASLPAQRWKWVSRNRLFNLGATQCLGTGWPVTNTTVSLGMYECDREALSLRMAVSYTRGPVVPASGGSCKQCIQAWHLERGDQTRSGHWNIYGSEEDLCARPYYEVYTIQGNSHGKPCTIPFKYDNQWFHGCTSTGREDGHLWCATTQDYGKDERWGFCPIKSNDCETFWDKDQLTDSCYQFNFQSTLSWREAWASCEQQGADLLSITEIHEQTYINGLLTGYSSTLWIGLNDLDTSGGWQWSDNSPLKYLNWESDQPDNPGEENCGVIRTESSGGWQNHDCSIALPYVCKKKPNATVEPIQPDRWTNVKVECDPSWQPFQGHCYRLQAEKRSWQESKRACLRGGGDLLSIHSMAELEFITKQIKQEVEELWIGLNDLKLQMNFEWSDGSLVSFTHWHPFEPNNFRDSLEDCVTIWGPEGRWNDSPCNQSLPSICKKAGRLSQGAAEEDHDCRKGWTWHSPSCYWLGEDQVIYSDARRLCTDHGSQLVTITNRFEQAFVSSLIYNWEGEYFWTALQDLNSTGSFRWLSGDEVIYTHWNRDQPGYRRGGCVALATGSAMGLWEVKNCTSFRARYICRQSLGTPVTPELPGPDPTPSLTGSCPQGWVSDPKLRHCYKVFSSERLQEKKSWIQALGVCRELGAQLLSLASYEEEHFVAHMLNKIFGESEPESHEQHWFWIGLNRRDPREGHSWRWSDGLGFSYHNFARSRHDDDDIRGCAVLDLASLQWVPMQCQTQLDWICKIPRGVDVREPDIGRQGRLEWVRFQEAEYKFFEHHSSWAQAQRICTWFQADLTSVHSQAELGFLGQNLQKLSSDQEQHWWIGLHTLESDGRFRWTDGSIINFISWAPGKPRPIGKDKKCVYMTARQEDWGDQRCHTALPYICKRSNSSGETQPQDLPPSALGGCPSGWNQFLNKCFRIQGQDPQDRVKWSEAQFSCEQQEAQLVTIANPLEQAFITASLPNVTFDLWIGLHASQRDFQWIEQEPLLYTNWAPGEPSGPSPAPSGTKPTSCAVILHSPSAHFTGRWDDRSCTEETHGFICQKGTDPSLSPSPAATPPAPGAELSYLNHTFRLLQKPLRWKDALLLCESRNASLAHVPDPYTQAFLTQAARGLQTPLWIGLASEEGSRRYSWLSEEPLNYVSWQDEEPQHSGGCAYVDVDGTWRTTSCDTKLQGAVCGVSRGPPPRRINYRGSCPQGLADSSWIPFREHCYSFHMEVLLGHKEALQRCQKAGGTVLSILDEMENVFVWEHLQTAEAQSRGAWLGMNFNPKGGTLVWQDNTAVNYSNWGPPGLGPSMLSHNSCYWIQSSSGLWRPGACTNITMGVVCKLPRVEENSFLPSAALPESPVALVVVLTAVLLLLALMTAALILYRRRQSAERGSFEGARYSRSSHSGPAEATEKNILVSDMEMNEQQE

SEQ ID NO: 306 - DNA, 3987 bp, Rat
agtatggagagaaggtcgtttaaaaaggcagatgtccctttaaggtttgctttgctgctgcccgtggactttagcctaaacagggtcccgcgaagttggctttatttgtccatgtctcggacacagcctgggtagctgccagtgagatttcagggacggagcgcgcaaaggggggggaaatgtggcaatccatctgggatgtgagacgcgtggagagggcttagcagcatttgaccaaaacacaggaaatcactcctccacagctcctgggcgcagcagcggctggggccactgccggacaccctcggagaccacacgagtgacccagagcgcaagtcgccagcgtcccggttctgcctgttcctgccagctcctgcccacgaaccggcacgtagctggttccagcagccgctccagcaatggtccccaggcgtcctgccagcctagaggtcactgtagcctgcatatggcttctcacggtcatcctaggcttctgcgtctccttcaatgttgatgtgaaaaactcaatgagtttcagtggcccagtagaggacatgtttggatacactgttcaacaatatgaaaacgaagaaggcaaatgggttcttattggttctcctttagttggccaacccaaagcaagaactggagatgtctataagtgtccggttgggagagagagagcaatgccttgcgtgaagttggacttgccagttaacacatcgatccccaatgtcacagaaataaaggaaaacatgacatttggatcaactttagtcaccaacccgaatggaggatttctggcatgtgggcccttgtatgcctatagatgtggacatttgcattatacaactggaatatgttctgatgtcagtcctacatttcaagttgtgaactcctttgcccctgtacaagaatgcagcacccagctggacatagtcatcgtcctggatggctccaacagcatctacccctgggaaagtgtcatcgcctttttaaacgaccttcttaagaggatggatattggccctaagcagacacaggtcgggattgtacagtatggagagaatgtaacccatgagttcaacctcaataagtattcatccacagaagaggtccttgtcgcagcaaacaaaataggccgacagggaggcctccaaacgatgacagcccttggaatagacacagccaggaaagaggcattcactgaagctcggggtgccaggaggggagttaaaaaagtcatggttattgtgaccgacggagaatcgcatgacaactatcgcctgaaacaggtcatccaagactgcgaggacgaaaacattcagcgattttccatagctatccttggccactataacagggggaacttaagcactgaaaaatttgtggaggaaataaaatcgatcgcaagcgagcccacggaaaagcacttcttcaatgtctcggatgagttggccctggtcactattgttaaagctctgggagaaaggatattcgctttggaagcgacagctgaccagtcagcagcttcatttgagatggaaatgtctcagactggcttcagtgctcactactcccaggactgggtcatgcttggagcggtgggagcctatgactggaacggaactgtggtcatgcagaaggctaaccagatggtcatccctcataacaccacctttcaaactgagcccgccaagatgaacgagcctctggcttcttatttaggttacacagtgaactcggccaccatccctggagatgtgctctacatcgctgggcagcctcggtacaatcatacgggccaggtcgtcatctacaagatggaggatgggaacatcaacattctgcagacactcggcggagagcagattggttcctactttggtagtgtcttaacaacaattgacatcgacaaagattcttatactgatctgcttctcgtcggggcccccatgtacatggggacagagaaagaggaacagggcaaggtgtacgtgtacgctgtgaatcagacaaggtttgaatatcaaatgagcctggaaccaattaggcagacctgctgctcatccctgaaggataattcatgcacgaaagaaaacaagaatgagccctgcggggcccgcttcggaacagcaattgctgctgtaaaagacctcaacgtggatggatttaatgacgtcgtgattggagctccgctggaagatgaccacgcaggagctgtgtacatttatcatggcagtggcaagaccataagggaggcgtatgcacaacgcattccatcaggtggggatggcaagaccctgaaatttttcggccagtctatccacggagagatggatttaaatggtgacggtctgactgacgtgaccattggaggccttggtggagcagccctcttctgggccagagatgtggctgtagttaaagtgaccatgaattttgaacccaataaagtgaatattcaaaagaaaaactgccgtgtggagggcaaagaaacagtgtgcataaatgctacaatgtgttttcatgtgaaattaaagtctaaagaggactcaatttacgaggctgatctgcagtaccgtgtcacccttgattcactgaggcagatatcacggagctttttttctggaactcaggaaaggaagattcaaagaaatatcaccgttcgagaatcagaatgcatcaggcactccttctacatgttggacaaacatgactttcaggactctgtgagagtgactctggattttaatctcactgatccagaaaatggtcctgtacttgatgacgctctgccaaactcagtccacgaacacattccctttgccaaagactgtggaaacaaggaaagatgcatttcagacctcactctgaatgtgtccaccacagaaaagagcctgctgatcgtcaagtcccagcatgacaagttcaacgttagcctcaccgtcaaaaacaaaggagacagtgcgtacaacaccaggacagtggtgcagcattcaccaaatctgattttttcgggaattgaggagatccaaaaagatagctgtgaatctaatcaaaatatcacttgcagagttggatatcctttcctaagagcaggagaaacggttaccttcaaaataatattccagtttaacacatcccatctctcggaaaatgcaatcattcacttaagtgcaacaagtgacagtgaggagcccctggaatctcttaatgataatgaagtaaatatttccatcccagtaaaatatgaagttggactgcagttttacagttctgcgagtgaacatcacatttcagtcgctgccaatgagacgatccctgagtttattaactccactgaggacattgggaatgaaattaatgtcttctatacgattagaaagagggggcatttcccaatgccagaacttcagctgtcaatttcattccccaatttgacggcagatggttatcctgtactgtacccaattggatggtcatcttcagataatgtgaactgtagaccccggagccttgaggacccctttggcatcaactctgggaagaaaatgacaatatcgaagtctgaggttctcaaaagaggcacaatccaggactgcagtagtacgtgtggagttgccaccatcacgtgtagcctccttccttccgacctgagtcaagtgaatgtctcgctcctcctgtggaaaccgactttcataagagcacatttttccagcttaaaccttactctaagaggagaacttaagagtgaaaattcatcgctgactttaagtagcagcaaccggaagcgagagctggctattcagatatccaaagacgggctcccaggcagagtgccgctgtgggttatcctcctgagcgccttcgcggggctactgctgctaatgctccttatattggctctgtggaagattggattcttcaaaaggccactgaagaagaaaatggagaaatgaaaggtttcatagaaaaaaaaaaaaa

SEQ ID NO: 307 - protein, 1180 aa, Rat
MVPRRPASLEVTVACIWLLTVILGFCVSFNVDVKNSMSFSGPVEDMFGYTVQQYENEEGKWVLIGSPLVGQPKARTGDVYKCPVGRERAMPCVKLDLPVNTSIPNVTEIKENMTFGSTLVTNPNGGFLACGPLYAYRCGHLHYTTGICSDVSPTFQVVNSFAPVQECSTQLDIVIVLDGSNSIYPWESVIAFLNDLLKRMDIGPKQTQVGIVQYGENVTHEFNLNKYSSTEEVLVAANKIGRQGGLQTMTALGIDTARKEAFTEARGARRGVKKVMVIVTDGESHDNYRLKQVIQDCEDENIQRFSIAILGHYNRGNLSTEKFVEEIKSIASEPTEKHFFNVSDELALVTIVKALGERIFALEATADQSAASFEMEMSQTGFSAHYSQDWVMLGAVGAYDWNGTVVMQKANQMVIPHNTTFQTEPAKMNEPLASYLGYTVNSATIPGDVLYIAGQPRYNHTGQVVIYKMEDGNINILQTLGGEQIGSYFGSVLTTIDIDKDSYTDLLLVGAPMYMGTEKEEQGKVYVYAVNQTRFEYQMSLEPIRQTCCSSLKDNSCTKENKNEPCGARFGTAIAAVKDLNVDGFNDVVIGAPLEDDHAGAVYIYHGSGKTIREAYAQRIPSGGDGKTLKFFGQSIHGEMDLNGDGLTDVTIGGLGGAALFWARDVAVVKVTMNFEPNKVNIQKKNCRVEGKETVCINATMCFHVKLKSKEDSIYEADLQYRVTLDSLRQISRSFFSGTQERKIQRNITVRESECIRHSFYMLDKHDFQDSVRVTLDFNLTDPENGPVLDDALPNSVHEHIPFAKDCGNKERCISDLTLNVSTTEKSLLIVKSQHDKFNVSLTVKNKGDSAYNTRTVVQHSPNLIFSGIEEIQKDSCESNQNITCRVGYPFLRAGETVTFKIIFQFNTSHLSENAIIHLSATSDSEEPLESLNDNEVNISIPVKYEVGLQFYSSASEHHISVAANETIPEFINSTEDIGNEINVFYTIRKRGHFPMPELQLSISFPNLTADGYPVLYPIGWSSSDNVNCRPRSLEDPFGINSGKKMTISKSEVLKRGTIQDCSSTCGVATITCSLLPSDLSQVNVSLLLWKPTFIRAHFSSLNLTLRGELKSENSSLTLSSSNRKRELAIQISKDGLPGRVPLWVILLSAFAGLLLLMLLILALWKIGFFKRPLKKKMEK

SEQ ID NO: 308 - DNA, 10 bp, Homo sapiens
gatctccgtg

SEQ ID NO: 309 - DNA, 17 bp, Homo sapiens
ggggctgcccagctgga

SEQ ID NO: 310 - DNA, 17 bp, Homo sapiens
catttttatctactgtc

SEQ ID NO: 311 - DNA, 17 bp, Homo sapiens
ctttctttgagttttaa

SEQ ID NO: 312 - DNA, 17 bp, Homo sapiens
tattaactctctttgga

SEQ ID NO: 313 - DNA, 17 bp, Homo sapiens
tattaactctctttggg

SEQ ID NO: 314 - DNA, 17 bp, Homo sapiens
caggagaccccaggccc

SEQ ID NO: 315 - DNA, 17 bp, Homo sapiens
ggaaatgtcagcaagta

SEQ ID NO: 316 - DNA, 17 bp, Homo sapiens
cctggttcagtctccac

SEQ ID NO: 317 - DNA, 17 bp, Homo sapiens
tttttaagaactcgggt

SEQ ID NO: 318 - DNA, 17 bp, Homo sapiens
tttggttttccaaaaaa

SEQ ID NO: 319 - DNA, 17 bp, Homo sapiens
tttggttttccaaaaga

SEQ ID NO: 320 - DNA, 17 bp, Homo sapiens
tttggttttccaaaagc

SEQ ID NO: 321 - DNA, 17 bp, Homo sapiens
attttgtatgattttta

SEQ ID NO: 322 - DNA, 17 bp, Homo sapiens
actttagatgggaagcc

SEQ ID NO: 323 - DNA, 17 bp, Homo sapiens
gagtgagacccaggaga

SEQ ID NO: 324 - DNA, 17 bp, Homo sapiens
gagtgagacccaggagc

SEQ ID NO: 325 - DNA, 17 bp, Homo sapiens
gtacacacacccccacc

SEQ ID NO: 326 - DNA, 17 bp, Homo sapiens
ccacaggggaattcggg

SEQ ID NO: 327 - DNA, 17 bp, Homo sapiens
ccacaggggattctcct

SEQ ID NO: 328 - DNA, 17 bp, Homo sapiens
ttaaaagtcactgtgca

SEQ ID NO: 329 - DNA, 17 bp, Homo sapiens
acagactgttagccaag

SEQ ID NO: 330 - DNA, 17 bp, Homo sapiens
ctataggagactgggca

SEQ ID NO: 331 - DNA, 17 bp, Homo sapiens
taccacctccctttcct

SEQ ID NO: 332 - DNA, 17 bp, Homo sapiens
taccacctccgttgtat

SEQ ID NO: 333 - DNA, 17 bp, Homo sapiens
gccctttctccgtagtt

SEQ ID NO: 334 - DNA, 17 bp, Homo sapiens
gccctttctctgtagtt

SEQ ID NO: 335 - DNA, 17 bp, Homo sapiens
ttaaatagcacctttag

SEQ ID NO: 336 - DNA, 17 bp, Homo sapiens
agacatactgacagaat

SEQ ID NO: 337 - DNA, 17 bp, Homo sapiens
tcccccaggagccacca

SEQ ID NO: 338 - DNA, 17 bp, Homo sapiens
tcccccaggagccaccg

SEQ ID NO: 339 - DNA, 17 bp, Homo sapiens
tacaaatcgttgtcaaa

SEQ ID NO: 340 - DNA, 17 bp, Homo sapiens
cattatccaaaaacaat

SEQ ID NO: 341 - DNA, 17 bp, Homo sapiens
agaaaccacggaaatgg

SEQ ID NO: 342 - DNA, 17 bp, Homo sapiens
accaaaaccaaataggg

SEQ ID NO: 343 - DNA, 17 bp, Homo sapiens
tgaaataaacccagttt

SEQ ID NO: 344 - DNA, 17 bp, Homo sapiens
tgaaataaactcagtat

SEQ ID NO: 345 - DNA, 17 bp, Homo sapiens
gtggagacggactctgt

SEQ ID NO: 346 - DNA, 17 bp, Homo sapiens
tttgtgttgtatattta

SEQ ID NO: 347 - DNA, 17 bp, Homo sapiens
ttatgtttaatagttga

SEQ ID NO: 348 - DNA, 17 bp, Homo sapiens
tggaaatgacccaaaaa

SEQ ID NO: 349 - DNA, 17 bp, Homo sapiens
tggaaatgacccaacgc

SEQ ID NO: 350 - DNA, 17 bp, Homo sapiens
tgccacacagtgacttg

SEQ ID NO: 351 - DNA, 17 bp, Homo sapiens
gatgaggagactggcaa

SEQ ID NO: 352 - DNA, 17 bp, Homo sapiens
atcaaaggtttgattta

SEQ ID NO: 353 - DNA, 17 bp, Homo sapiens
agtcacatagtacataa

SEQ ID NO: 354 - DNA, 17 bp, Homo sapiens
ttcggttggtcaaagat

SEQ ID NO: 355 - DNA, 17 bp, Homo sapiens
ccccacacgggcaagca

SEQ ID NO: 356 - DNA, 17 bp, Homo sapiens
ggcttgcctttttgtat

SEQ ID NO: 357 - DNA, 17 bp, Homo sapiens
atcccttcccgccacac

SEQ ID NO: 358 - protein, 69 aa, Homo sapiens
SLGDRVRLSPKKRKKVIQCSFYRDKRSNSSGWVWWLMPVIPTLWEAKAGGSHEVRSSRPAWPTWQNCLY

The invention claimed is:

1. An isolated and purified nucleic acid molecule comprising the sequence as shown in SEQ ID NO: 173, said sequence encoding a transmembrane TEM1.

2. An isolated and purified nucleic acid molecule comprising the coding sequence for a transmembrane TEM1 as shown in SEQ ID NO: 177.

3. An isolated and purified nucleic acid molecule comprising the coding sequence for an extracellular domain of TEM1 comprising amino acid residues 1 to 685 as shown in SEQ ID NO: 177.

4. The isolated and purified nucleic acid molecule of claim 3 which consists of amino acid residues 1 to 685 as shown in SEQ ID NO: 177.

5. The isolated and purified nucleic acid molecule of claim 3 which comprises nucleotides 6 to 2060 as shown in SEQ ID NO: 173.

6. The isolated and purified nucleic acid molecule of claim 3 which consists of nucleotides 6 to 2060 as shown in SEQ ID NO: 173.

7. A cultured host cell comprising a vector comprising a cDNA which encodes an immunogenic agent, wherein the host cell expresses said immunogenic agent, wherein the immunogenic agent comprises the extracellular domain of TEM1 comprising amino acid residues 1 to 685 as shown in SEQ ID NO: 177.

8. The host cell of claim 7 wherein the cDNA comprises the sequence shown in SEQ ID NO: 173.

9. The host cell of claim 7 wherein the cDNA comprises the coding sequence for a transmembrane TEM1 as shown in SEQ ID NO: 177.

10. The host cell of claim 7 wherein the cDNA consists of a coding sequence for amino acid residues 1 to 685 as shown in SEQ ID NO: 177.

11. The host cell of claim 7 wherein the cDNA comprises nucleotides 6 to 2060 as shown in SEQ ID NO: 173.

12. The host cell of claim 7 wherein the cDNA consists of nucleotides 6 to 2060 as shown in SEQ ID NO: 173.

13. A method of making a TEM1 protein preparation, comprising:
    culturing a host cell comprising a vector comprising a cDNA which encodes an immunogenic agent, wherein the host cell expresses said immunogenic agent, wherein the immunogenic agent comprises the extracellular domain of TEM1 comprising amino acid residues 1 to 685 as shown in SEQ ID NO: 177;
    isolating protein expressed by the host cell from other cellular constituents.

14. The method of claim 13 wherein the cDNA comprises the sequence shown in SEQ ID NO: 173.

15. The method of claim 13 wherein the cDNA comprises the coding sequence for a transmembrane TEM1 as shown in SEQ ID NO: 177.

16. The method of claim 13 wherein the cDNA comprises the coding sequence for an extracellular domain of TEM1 comprising amino acid residues 1 to 685 as shown in SEQ ID NO: 177.

17. The method of claim 13 wherein the cDNA comprises nucleotides 6 to 2060 as shown in SEQ ID NO: 173.

18. The method of claim 13 wherein the cDNA consists of nucleotides 6 to 2060 as shown in SEQ ID NO: 173.

19. A cultured host cell comprising a vector comprising a cDNA which encodes an immunogenic agent, wherein the host cell expresses said immunogenic agent, wherein the immunogenic agent is selected from the group consisting of TEM 1 protein as shown in SEQ ID NO: 177 and an immunogenic fragment of said TEM1 protein.

20. A method of making a TEM 1 protein preparation, comprising: culturing a host cell comprising a vector comprising a cDNA encoding an immunogenic agent whereby said immunogenic agent is expressed in the host cell, wherein the immunogenic agent is selected from the group consisting of TEM1 protein as shown in SEQ ID NO: 177 and an immunogenic fragment of said TEM1 protein; isolating protein expressed by the host cell from other cellular constituents.

* * * * *